United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 37

SEQ ID NO: 484 - DNA, 129507 bp, Homo sapiens
atatcaagttgtcaatgtaatttatataacttttatttttatataatttcacatgtacagaaaaatacccatatacctttacccaaatagctaccaccaagaaatctctgttgtaacatttcaatcgccattccctctgaaataataacaaagcactttatttgagtattccgtattccccaaagctagctgtgaaagacctacatcacctcaaaaccttccatttggttccatagatcctgccatgtcacattcttgtaaccagctgcagggccatcttgttataactggttcatgtcctgctaaagctgagaggtgaagggctaaaaacacagtcctggcacagattccaggacaccccggcacaggcttgtttgaggacattgcctgggtaaacagcctcccctgaaagtgttcagtgtacaactcttcacagagcaatcgctcaaatgcgtggcagcacgcagacatgtctctcggcttctctccttgtctctgttgccttcctctccagtcggtgctttagaaatgctttattcccattgtccactgaaaatacaacctagattccttcagtaaatatctgttaaggaggtcacatgaaaagattgctccaactcattcttgctggtgggctcccaagggtaaaataatatagttcgtgtcttctcagtcatgaggaaaccattgtcactaaatctccctgggatgcttcctacatccaaccaaacaaagggagcgacagctgaggtctccaggtcaaaaacaaatatgtcaccttgctgagagatgatggcctgaaaaagaaaaaaaaaaatgaatgaagtgaaggatgagggaagagttatatagtctgtatacagttcctgtaaacatttatgtgggcttaacaaggagtccacttcccacaactttggttctacaactgctaaagtgcagtttcaaacacaaaacaatacatggaaaatgactacaggctatggaacgttaccaaattataatcacaaatcaaggaaatacatcgtctccaatcattaaggagaatatttcacaagaagctcaaagctttacatcttttacagtttttctcagagtatcatcaagagagcaacatttttacatacagcctgggtggttttaatgactttctaaggatatatctggacctagctacagagcccaactgtggagcttacattcaagtctcctgaaaagatccagcaatctagaaagtccactgccagaaatttacaaaagctctaccattagagcttatctcttttactgcatagttaagtaaagtcacattattagcattttttttacatgtgtgaattccacaaaatagcagcaaaaagagacagtgcaatttaaatcgtgttggctccattcctcttaagtagccgaatagcatatgcccagagtgaggatgcgctgctccccagagtgggagggtttgcaaacctctctttgtgtgagcacggagctgagtgcaacctggtttcttaatctgtgcatttgtcatgcaacatctcagtcttacattatatgttatgtgtgacataaagaatttcaaagggccattttcactatatataatttagccttacatatttgtgtaatatgttatcattcagggttctgagttatacacaaggaaacctatattgatagaagcagaaaagaagcttaataaagcgtatcaggttgctcttcaggatcagagactcaggcttgaatttggatggcaaattcccagatcgcaccgcccagctgttccagtgaaggtcctaaagcagccacaggaacaaggttcatgcggctcatgccagcctgcccaggaagctgccagggtagcatcagcttctgctgctccaagaccaaggccgaaagagatgctggtgtcatgcttatgctggttatcttcgttggattggaaatctcctctctgtatgtctgactgcagagcctgggattcaagcttgcaccctggcttcagggagacagggagaacaagtttctggcatctcccttgagaaaagaagccaaatacctagtctatattagccccgaattaaacattaactaacagtattattactatcattttatctctttaagaaggacaagtctcactgaaatcaaaatgagatagaacaaagaaagagccctgcttttctcccaccccaattacccacctcaaggtaatgaaggcctaactcaggaaagaaaaaaatttggttttcaaaatcataagtttagagactgaaaattcatccagtacatagtggttttttttttcttttttggaaaaaaatatatgtaagactgtcattttcttctgttctctattagttgttacagataacttggattttattatgtgactatagaaagaaggtatgttttcagttgttaggctctttcaaataaaacacaagaattaggtgtttttatatgattatttctaaattaaatgtagaaaatccctttctatgaagtaaaagtgtaaaacaaatttaaaattttctaaaaacagagaatgtaactttctagaaagatatttcctgagtgtccagaagataagataataaaattaaaaacatatatgtgtacatatatttccaactgctatgtgtaggggagaaggaaggaaaggttttcaacctactagacaaattccaaattctccagctgcacaatttttataacaacacatcctgatcatcccatttttatatcttggcaattataaaaagatttggtgattgagctactttgaagcaataaatcaaagagactagagtgaatattaatagactctacttaaaattagactgcgtcagctgggctccaatgcttcccagctacaggacctcgagctcatcacttaacctcctaaactggcttccaaacttacaaaatgcagatgataatgcctggagctgtggtgaaagtcagagactatgaggtgaagcacctagaacacagcctggaacctagtgggcatgcaggcagtggtgatgactcgagcttcctctcccatcactgcacctgcccactaaggaggggtgatgggacaaacgagtagtggtcaccagcaactctgacaaatcctggattcgaaatagaaatcatttggtgtttgcttttagtgggaagaggccaatcttcccccaggcctcaggtaaactcagcaccaagggggacacatgcaaatctcaggatgcaaggagctggcccaagagcaggagaaccccacaaggccacagtcccctgccctccgccatgacctgtgcttacagtgatctgcgccttgcagagccccacggcctccttcggtgaggacaagaagtggtagttggtcgggctcaggagttcatggtcagctgaaaggtaaaaggaaaccacacagctttcccgtgtgcaattcccacatctcctcagcaattcagacactggctcctcataaaggcagacagcctctcctcctttcatcacaaaacgttcagtcacacgagagcacacgggctccagggagctccatgtatggactctcacctggggagaaataaaacagaataaaaacaggcattcttggttgctatgtttttaaggaacaatagtagtaataattgctgaaagtcaggttagcagaaatggttaagagactatgaaacctgagttttaatcccagtcctgcaaaatactagctatgtgactaagtaacttctcagtcttcatttcttcatatgtagaatgaaaataacagcagtaatgtcacaggctgttgtgagaatttaaaaaataatccacggaaggcacagtacctggtgcgttgtaatttttctgtaaatgtgacctattttcagtgttattagtgtcctccaaactatagccacctaagactttgagtttctagcctttctttttacttaaatttgttttttaaaacaaatttgctttccacatgcgcattctgaatagttttactgattttcactataacatgccatttttaaccatttctttttataaagtttggactatttccagcctctcacaattataaataaccttgcatttaaggggcacattatagcatatgtgatttgctttcatctagttattttatttcctactcatagaaatcctgtaagaagagagactggtatcattttactgagaagaaattgaatcaacaagatgtgaagggttttgcttatggtcacatgattaatggcagggttgtagcctgaatatatgtattctaactctaaattaatttctcttttattttcccaaaagaatgtaaccaaacaactaaagaaatcatctaaaagtctccttcgatcttagaaaacaatccaagtaacttacactgagtgtcatcgaataatccgagtgaagatctgacacaccatagatatagaacgtgttttcattctcaaagcctactggcaacagtggagcaaagaaattctgagcaaagtaatgaagcattttccactttcctccgtactctgaaaataatcaagagtgtcaggagacggcaaggtcaagtagtcagagaggcactgtccaatggcccagctgtttgtggctcatcggggttctaagggagtgagcatgtgagggagagtcaacagtggagggcacccatgtttgtgaagcgctctgagcactctggacattatgtcatgtcaccctcacaacatctgggcaggcactaacgaaccagggcaggcattaacgaaccatgctgttaggcaatttcatcattgtgtgatcatagagtgtacttaaacaaaccaagatggtatagcctactacacacctagactatatggtatagcctgttgctccaggctactaacctgtacagcatattgctgtgctgaatactgtaggtaattctaatcatagaaatgggacagtgaaaatacagtattataatctcatgggaccaccatcatatatgaactgtgttgttgactgaaatgttatacggtgcatgactgtatataataacttatagattctaggtagctattgattgctttaatatataaccatttcgggtgataagagataacaaatacctcccctactgcacgcactagaagcagtggatttattgagccaatcaacatggggctgtgaggcccccagagcagaagcagatatagaaaacttgtcacagcttctcccggataacctttttgtctaataagtacaaggagctggtgatcctcctcaggcaggcaggatcctgccagggtttagaaaacagccaagctctggtacttgggttttcctactgtaatattattatatatacatatataatttttcttctacagttagatatggtttggctgtgcccctacccaaatctcatcttgaattgtagctcccacaattcccatgtgttgtaggagggacctggtaggaggtaactgaaccatgggggcaggtctttcctatgctgttcttgtgatagtgaataagtctcacgagatctgatcgttttataaagaaggagtttcctgcacaagtcctctcttacccactgccatgtaagaagtccctttgctcttccttcgtcttctgccatgattgtgaggtcttcccagccatgtggaactgtgagtccattaaacctctttttctttacaaattaccagtctcaggtatgtcttcatcagcagcatgagaacagactaatacaggttcctagctcacaactaccatagcccttgttacagactcttgttataatgttgagaagctttaggactcaaaagcaggcctcagaaaacagaatctatctctctgatctccttccctcctttcaccagcccaaggcaggtctctaatccgattgtgggtcataagacactcattcagaaggtgtcctgcctcataccctggaggaggaaatgcttcacagagaggccaagaagctgaatggacaggccttgctgtgtttccccactcagtctaatggtattagatcatacccgctttgtccaatcacatttctacatggttatcaatcatggctgtccaatgaagtctccctataacgcccaagaggacagagttcaaagaacttccacatagctgaccatgtgaaggctgacagaaagaggaacaagtattcatctacatgcctggagggtggcacaccccagcctcacagggataaagttcctgcactcaggacccttccagacttcaccccatatatctcttcatacggctgtttatttgtgtcttttaaaacatcctctgtaatacagcagttagaatgtttccttgagttctgtgagccattccagcaaattaaacccaaagaaggggtcatgggaaccccagcttgaagctggtcagtcagaagttctagaggcccagacttgcgactgctgtctaaagagggaaggcagctttgtggaactgagttctcaacctatggaatctgatgcaatctgcaggtagatagtgtcagacttaaattggagggcactcgcatggtgtccactgcagaagtgattgcttgcttggtgtgtgggggaagtttcccatatatttggtcacagaagtcttctgtgtggattgttgttgtggagtgagggaattaacaaagcacttttaggccaggtgcggtggctcatgcctgtaatcccaacactttgggaagctgaggagggtagactgcttcagaccaggtgttcaagaccagcctgggcaacatggcaaaaccctgtctccagaaaaaaaatacaaaaatgagccaggcatggtggtatgcagctatagacccaggtactcaggaagttgaggtgggaggaaggcttgagcctgtggggtggaggctacagtgagccatgattgcaccactgcactccagcctgggcaaaagcagagtgagaccatctcaacaaaaaaacaaaacaaaacaaaaaaccacttagagtttgagtgtcttgtttcccacagacctactcttcctgaggaactcaggaataatctgcatgggatcacttaaaggaatatttacaaaaattgggctctcccatttcttgaatcgaactcagtttcagtccacaacctcatccacagacagaaagcaggatcagtatccaagagtctctgaacagttatctctttgcctacctttccagcatcccagaaggattttccccccaattctacccctgattctcattcaatgctctcttatctggttggtgctgataaagagtttggtcagagaaatttgattagaaatccaattctctgtaagagtcatccatctggcactaatgaaaacatgtttggaatgaatttcttttgatctgcattcacagccagtttaagagcctcacccctgcactctagcctgggtgtcagaacaagactctgtctcaaaaaaaacaaaaagaacctcacccaacctttctactttgtggccttgcctcgtttttgaccccaaactattctttacattattaactgaactttgtttcaagtcatctctagtgaagggcaaagactattattccttaattttttttaatgtaccagaatagatgggataattcgaactgcaggttccatgccagtcatctcacctgttgctagttgaactgtttcaactggtcacctttcccattcgggattctgcctctactagcttttccccaagagctaaacagggcataataaagatggccttaagagacatcttcattatgtccttaaaggacatctttatttgtccttaaaggtgaatcagagaaagggaaactttaacacataagcgggccaaacttctacctgattgaattctccaacacagaagaagggatgcttaagttcatgcttctttagccctggaatgccctcttaaataaattcaaaattctatgcgtaataacaagacacatggctgagacttttgtataggaatctatcccatgcttagcctgctgttgcaactttgcacagcacagaacccataattaggttgaccctaaggctcatggaaaggctactaaggtgagttgggtggctgtagttcctaggcaggctttttaaagaatgactcttttggtcatagttctgcctgggctaatctgacccctccagcactgtgctttctcagtccctctccccacagtgttgctttctctcactcgcacaaagaacgctgaaatgcttaccaagagaagcccaggaaggagcttgccagatgtcattcaactgccaataaagtgcccccatcgtgtgcccttgctgatccactatctcgctgcgactacggcggtagaattcagtttctgttttgacacactgggcctgcatcacctgattcaggaaaacattcatacacaggtgttattgtttgatgtagactgcctagatctgagaaaaatacagggtttagttttgttttgggttttttctttttggagcaatttggataaaattagggaatttaattagtattaggaatacattatactagatctgtaactagccccttagcatgagagaagctgttgtctgtaacagtgggtttgtctggtagacttggtgtttcattatggtgacaatggaaataggatggtgtaaaaggttctctgctaatgatagtgtaggccgtaaagaaaaacaaagactactattccagagcaaatgctatatatagtccaaaactagattattttcactgaaaaattttgctaataccttcatagctatttttaagaaaaacttttactagaaaaaattctataagaaaaataacattgttattatgagtctgatattatccaatccctaattattttttctagtcaaacaattgttttgatgtcatgatttttggtaatgtaagatttctcatgaatgcaattccttcgttgtagcagaacagatggcaaattgcagcaatgagacaaatgaatttagttcttgtttaagagacactaaagaacttcacacaggacccttgattaccgacaccatcatggaaaaatcagtctcttttatcgctgccgttaccgacacatatgaatcacatgctcttagcctggagttgtgctgaggaggggctcatgaatggaccactgaggagaacccagagatggtcagagcagcgaggatttcagagaacaagaaggccttagaatagggctggggttttcacagaggaataaaaagaatggtgcatatggccaccaaaagactaagtcgagacgctttcccataaaagcaaaaaagctcagataaaggtagaacctttaaatagaggaaggctgaccagtaaggaagtcatagatgaggttatgacttacatgagtcacagccatcaaattccagaacggaagccagaagaaattgtggtcagtcaataaatatttaataagaacctgcaggatatgttacatactgagaatggtgggcacccctgccagaaaaaaatgatacagcccaccatatggagcttatcagcttgtgtagaagacagtccttcatcaaagaatcacagaaagatacgtaatcattaaacagtaccaatgctaagtagaagaggtatgcaatgttacaagctcatatggtggggcaattgggcagagctgtagagtgaggattggcctaaaagaagaggaatgggaaaaagagagagggcagaaccttccagagaggacaatacaccattggaggaggatgccaggtcagctaagaactgaaggaaggccaagaaggcctgagcacaggaagccgggagcaatggaagagaagctggtgagaattgcaggggccagaccctggaaggccacatgttgaaggtgttggtgtgcatcctaaaggcaaatggaggtcacaaaaggcttttgaactaaagggtgatgtgagcagatttacatttccaaaagatgactgagactactgaaggaggaagggcttgcaagggggctagagtggatttaggtagaccatttaggcaagagatggttttagctatgagcagacaaagcaatgtcttctcattcaggaaccagaccactaggaccacagcaacagtagctggaaaaaatgttctaaagcaagaatctcacaaagcaagcagcattggtgccacctcaaaatgaccatggcccctataaacatttgagttttcagtctctaaactatatcaattttcagcattatctgcaagatatatttatttctatatatccattctaacattaatctcctcactataagttattttttcctggtttaataggtaaaacttattagttccttagaattttcaaaatttgaaaaaattttaaatgcaagtaggattcctaaccctcactagcaatgaaaagaaaagagcacaaagtggctctatctagtagcctctcttacaggaaattagcatgaaagagcataaccaagactcttttgtgctccaggctctggcacagtgcagtacactccacacacagatggtaccatgctaataacatggacctgaatctatccaaaccagtgggtaccagtcaaggctaatgaatgacacctttgttcataaaaatgcagaaggctattgcccactaaacttcttaaaggggtgttgtacaatcctagttccctggaaaatctctagaacttccccttcccctttaaaaactgtacctatatttacacatccatgcatcctttcctaaaaagggcaatctttacacataagagggataaatgcttagtcattttctaggttatccagtccactgttagcagacaaatgaattttagttttaaaaatatgcctatttggctgggcgcgatagctcatgcctgtaatcccagcactttgggaggctggggtgggtgaatcacgaggtcaggagatggagatcatcctggctaacacggtgaaaccccgtctctactaaaaatacaaaaaattaaccggacgtggtggcacatgcctgtagtcccagctactcgggaagctgaggcaggagaatggcttgaacttgggaggcagaggttgcagtgagccgagatcaagccactgcactccagcctggacaacagagcgagactctgtctaaaaaagaagaaaagaaaaaaatgcctattctcagcagcttgcttgattacacttatgaaatgagtctcctatgagagacagatggtatggtgagaagaaattggatcaagatacgaagacctaagttccagttccagcactgccactggtggttgctagctgtcttccaaaaccaatatccctttcctccagagtgatggagttgtagctggactacattttccagaaacacaccccaacccctgggactttgagtagccatgtgactaagttccctcaatatctatatactttatttactaaaattatcccgacactaagaatcttccaacaaagctgttttaaaaccaagatataattcacataccataaaattcatcattttagaggttataattcattggtttttagcacagtcataaggttgcacaactctttccactatctaattccagaatattttcatcaccccaaaaagaaacaccatactgggaagcagtcactccccatcctcccctctccccggcttctggaaaccacttaatctacttcctctgttctgggatttgcctattccggacatttcacataaatggaatgataaaatatgtggcttctgtgactggcttcctttttatttctgaataatattttattgtatggagatgctacattttgcttgtctattcgtcagctgaaaaattaggttatttcccctttttggctactatgaacaatgctgctatgaatctgtgaacaggtttttgcatgaacatatgctttcaattttcttgagtatatatacctaagagtaaaattgctgggtcatatggcaaactctatgtctaactttttaaggaattaacaaactgtttaccgcagcagctgaactgttttacattcccaccagcaacatatgagggttccaatttctccacatccttgccaatactcattattttccttttttaaaaatttgtagatattgtagtggatataactggtatctcactgtggttttgatttgcatttctctaataactaatgatgttgagcatctttctatgtgtttactggtcattttctttaaagaagtgtttattcaaagcctttaccaatttttcaattgggttgtctttttcactattgagttctaagagttctttatatattctggatgctggatccctatcagacatatggtttgtaaattttttctttcattctggggattatcttttcattttctcgatagcgtcttttgccatacaaaaggtatttttgttttctgtttttgatgacatacaatttgcctattttttctttggttaatttctttgatggcaaatttaagaaactgttgcctaaccaaaagccataaaatttatacctatgtttccttctaagagttttatagttttagctattacatatagatctttgatccattttgagttaatttttgtatatggtatgaggtagtggtctgaatttattcttttgcatgtggatatccaattgttccagcaccacttgttgaaaacatgattcttcctcccattttattctttttaccatttggaatgtaaattagtacagccattatgcaaaacagtatggaggcttcccaaactattaaaaatagaactactatatgatccagcagtcccactactgtgtatctatccaaaggaaatgaaatcagtatgttgaagagatatccacactcccatgttcattacagcattatttacaatagccaagatatgaaatcaacagatgagtacataaagaaaatgtgatacatatacacaatagaatacgatccagccttaaaaataaaggaaatcctgtcagttgtgacaacctggaagaaactggaggacatcatgttaagtgaaataagtcatgcacagacaaacaaatactacatgatctcacgtatacatggaattgaaaaaagttaaactcatagaagcacagagtagaatggtgggctggatgggggaaagaggaagtaccaaggagatgctggtcaatgaatacaaaatttcaattaggagaaataagttcaagagatctattgtaaaacatggtaactataattaataatgtattgtatatttgaaaattgctaacagggtagattttaagtgttctcactacaaaaaagataagtacgtgaagcaatgcatatgtttaacagcttgaattagccattccataatgtacacatataccaaaacatcatgttgtacaccacaaatatatatttttaatttatcaattaaaataaagaaatattaatttttttaaaaaaagaaaatcagttgaccataaatgtatatttgttcctggattctcaattttattgaatcaatctattatatataccttgtcttttgtcattaccacactgtcctgattactacagctttgaagtaagttttaaaatctttttttcaacagtataagatttgtcaaatgctttttcttcatttattgagatgatcatgtgtattttttctttctttactaatatggtttattatactgattaactttcatatatcgaatcaatcttgcattcctgggatatttcccacatagttatgctatataatcctttgtatatgctgctggatttggattgataccattttattgaggatttttttctgtctacattcacaaatgatatgagtctgtaggttgcttttcatgagatatgtttgtctggttttggtatcacagtaatgttggcttcacagaatgagttaagtgtttcctcctcttattactaattttttagggagttaatgaggggtttcttttaattcttctttaaacattcttagaattcactagtgaagccatctggtcctggatttttctttttacgggaaggtttttttgtttgtttttgttttttaactaactcaatctccttagttgttatagggctattaagattttctatttcttcttaattcagttttcatgggttgtttctctaggaattcatccatttcatctaaattaactgacttgttgccatataattgtgtatatattctcttatcaccttatttattttggtaaggtgagtagtaatatttcctctttcattcctgacttagtaattcaagtgtcctctcttttttctgggccagtctaactaaaggtttgtcaattttgttgatctattcaaagaactaacttttggcttcactggttttctccagtgttctaatgaggtctttatttaatgtgccaaatttctgatgcccactttacttaattgctgaaaattactgttaacaatttaaccaaacaccattattgcaactgtgaagggatagaatattacagtttaaaaagcagaaaccctactccattcattgccctgagtccttaggcaaaatatttaacttttctgagactctgtttcctcatgtatgaaatggaaagagtgatatgggtgtctggagataatgtgagaattaaatgataagatttacaaagcagttcatgacccaggaccaggcaggcatttagtagatacccaaagaatgctacatattggcttgattattaaattacatgatgcctatacaaactcctaatatataatacacaatgttaatggtcactctttcattcccctcctttgcccaccctactctcatcttaaaagctcagtatgacctggatcttccatcgtgtctcagtgctacttaccaaacaaataaccattccagggcagcaggtatcatcaaaacctgggcctacagcatcacctaccttttgtcctagttcttatgatcaagttacttacagcacaggaagataaaatgggcctctaaagaaaatgagtttctcaagaacatccccaagccatcattagatattcaatagacacatgaagaataaacaaaagcactagaaaaggctgtaagctaagggcttggtaattaatgtccttggcctggcctgctctcttagtggccaataagaggccgtgctggtagagtaagacactcaaaagttagtttagatatgttcatttagatagttggtcctcaaactagagagtgagatctgtgtaacatagctaaagagggtgtgctcatgtatatgggctattgggaatacaatataacagggcaagagggagagtaaaaggtaaggcaagattatcctggaatactaggagaattaaagaggcaggagcccatagggatatctttttggctataagacaaagagaagatagggaaggatccaaacgtgaagaaatttactggacagttttctcagcgaagactttgctaacagttgcaaatattccttaattaataaatcttctaaaaagtggcacataggcaagcactctgttcttcagaacagtatgacagactatgagaaaaagaacaggggttggagtaggaacatagaaagtggaacagagaagggttttatttctaatacacagattaaagaggactgttctaaaatcaaagtaacaaggaaaaaccctaaaaccctaacatttcctgtctgtatttcagtcaagaaaatctgacactgaaaacaaaataaaataatcataatcctgatttctttcatcacagatagcatctagtatgttggaaagtgccaaggtagacactaacaagccacacgaggacaagtccaattctgagccaaagcctgagaggacactagtgctaaattctcagacaaaaccatcaccaacaaaaactggcaacaaataactccacttgcatgcccagttcctaactatggaccttgaatgctgataagttcagaaaagaaaaattatttctatcagttcttggaatataattttgaggaaaagaataaagttagagtaataaacagctggaaggaggaaatccagcataaaaaacaatagcagaaaagtctcttatacacacacacacacaaataataatcagcctattttatatgtcagaacactttaacagagtattatctgtggaaaacttgaaagataaagtgcaacacttttcaagggacagataccaacattgcctttaaccttgtgttctggtaagttcatgaattacatataaccctggcaaaactttcctaacctataagattatgattgaaacattaaaattctcctaatcatttcatcaccttctaaaaaagattattctttcagcttacagttttctgctttagtttctatcatggggtttgtgttttcatacaggagaaaactgatgaaggtgtgagcatgagtttggattaaaattcatacatttttagatactaagataggaaaatttaactgtgattatgtttttaaaaatttcctgtctacttcagatcaactttattattgggattaggcttttacctcctctctaagaactttaaacaagtatggcaaaactagcaggtaaataaacagcgactttaatggagtcttaagtgtggtcacaggttcatgaactaaaataggcaaatgaaaaaagtaaaatgaaaccattatccaaaattcagtttggcagtttcttaaaaaaaatacataaatttgttatataactcagaaattccatttctaccctttgaaaaggaaatctatgtccatacgaagatttgtatatgagtattcctaacagcattattcataatagccaaaaattggaatacgatataacaaatgtccagcaacagatgaacctgacgaatggataagcaaaatgtgtataaccataaaactgaatagtatttggcaagaaaaaggacatgaactatacatgctataacatggatgatcttcaaaaactttatgctaggtgaaagaagccagatgcaaaagatcacatattgtataattccatttatataaaatgttgagaaaagtaaaatctatagagacagaaaatagatttatgttgtcttgcagctggaggtgggaaaggggagtgactgtaaatgggtacaagggatctttttagaatgacagaaatattctaaaattggatcatagtgatggttgcaccactctataaatatcacttaactgtacccttaagatgtgtgaattttatgatatgtccatcaaaacttgatagaactgtttttaaaatccagcaaggtgcatgccataacattcacaaatcttttgatacatgcacacatccatgtgactaccactcagatcaagatagaaaacagaaagttctcttgtaccccttcctaatcattgctcacaccctcctccacaagtgtagttaatactactttgctctctatcatcttgattgtttttttttctaatatgtacttttttctataatatacttaaatttcaatatagaagaaatcagtacagttatgtatccttttatgtctggtttcttttactcaatgtaatacctgcaagactcatccaagctgatgctgattatcagtagtttattctttttttattgctgtggagtattccactgtatgaatatactacaatttgtttataaattctcctgttaaaagacatttaggttgtttctactttggggctattgtgaataatgctgctatgaacattatttgagatatccattggtggacatatgaactcatttttcctagtgcatagctaggagcagaaatgctgattcaaaagggaagcaaacatttagcttaggtagaaactgccataaaattttccaaagtggttaaacaaatttaaactcctactaacaatgtctaaaatttccagctgtctcgcttcctcaccagcagttgttattatcaatctttttaattttagccattctgctgggtgtgtaggggtatactggtatggctttaatttgcatgttcttgatttacaacaagattgggcacattttcagatatttattgacgctttggatatcttctttagtgaagctccagttcaagatttttgtccatttttaaatagattgtctgactttttcttattgctttattctggatacaaatctttttatcaaatatatgaattaaaactattggtccccaatttgtggcttgccttttctctctcttaatggtgttttttatacttaatggtgtccataatttcaatggagtataatttatcaatactttcttttctagttagtgctttttatgttctatataaaaactctcacctatcccaaaatcatgaagctattccatgttttctcgaagctttattgtagtacctttcacatttgagtcttcagtcattggtcaaatgaagtttctaaaatttattattattttttagagatagggttcttgacattttgcccaggctggtctcaaactcctaggctcaatcaatcctcccacctcagcctcccaagtagttgggactacaggtgtgtgccaccatgctcaacaatcaaattaacttgtatatggagtcaagttcatttcttttcccataaaggtatccacgtgattcaccactgtttattgataaaatgattgttctcatactcaattgtggtggcatcacagccataaatcaggtgtccatattatacagtgatctgtttctggactctattgtgtcccattgttctattttatccttgggaaatggcactgtcttaattactaaccctttagagcaatcttgaagtagagaatattttcatacacaatttatttcagaattttgtgagctgtttttgtaagagaggcaaatgccaaaaatgaactatttcatgtcctatgtgtcatcatatatgttctttgaagaaaataaattccttaaccagtggaatgaaaacctgaatatttttcaccatatatggcctacaaaatctacataatctcttacattaattgcaggaacctgttcaattctagaatgaaaacaacttacctgagtaaggtagatggtatctttaaatgtgcgtaatggatctgtgctttgggggagtttgaaatgaagtccagcctgataaagcatttgtttgttaccaccttcgtgatgttgtcgatgaagtgaaaacttgctattgaaagaccagtcctctgtagacgagacctttcaaataaagaataagaattagaaatctgaaagttggcagtaaaactacttttctataagttcctgacaaacctggaaagtatcctaaacactagagaagaccttgaggtttgttctgtggctccagtttcataaatgttttaccatcctacttgttgccagtgaaggactagccttgtggaaactggaatcacaaaaccagggtttggtacatatatcctcccttcctccaactaagaaagttatattttgatgtttctcttaagactcttgttttatcaaaacatattcctggtttttgaaacatccactatatgtatttttaaatatcattttatctacttaggtaaacattttatctagtattcgtttgtcaaaacttaatagaatgcaatcaacactgttaaaactgtcacaattcttaaataggaataaaacacctattacactataatagggatactatgagagtagatgctttagcacttacactgttcacttgtttctcagtgattactaaatgaaactgatatacatatgtttaatttttatatagttgaagacacaaaccaaataatgttacttctctcccctaaaaaatcaattttttatggtttaagccaggcccaaattataggatctttattttatcccctaacttacaggatctttcttttgtcgtcagctcaaattaaaaaacaaagtaaaaaaaactcacatatgttggagtataccttctacaaaaaaagagaaaaaagcaataattctggcttctaggcctataatttaatgcactgttagcatttaagaaagaagacaattgctggctacatctgaaaatatccagagttttaattcaagttacacagactttgaaaaaacatactctgcccctccacccaaaaacctgaaaattaaaaaagcttaatccctgttcataaagtatgacttttcattcccagtaatcaagcaacacatgggcccattaccttaaaaggaaaaggttatccttcaggaactgattcatacccaaatataagaaatgtacactagccatattaaatttggaagtttttcctaattacagatgtttttccaaaatgccaccaccagaattaaataatgctaactactcctattatgtatttaaaggagagattcacattgacaatcatctcgcacactttttagacacacatcctttatcaatagtcttcctacgcttcctcctcttaatttattttatttatgtttattatttttaattgacacaataagtgtacacatttatggggtaccatgttataatttgatacatgtatacaatgtataaggatcaaatcaggctaataagcaaattcatcacctcaaacatttatcatttctttgtgtcgggaacactcaaaattatctcttctagctatttgaaaatatacaataaattattattaactatagttaccccaaagtgctatagaacaccagaacttattcttcccatctagctatacttttgtatcaattaaccaactctattgtccctccctggcaacccttccaccctctagtaatcattattccactctacttctttgagctgaacttttttagctttcacattggagtgtccttcctccttttcaaagtctgaaatatacctttgggccatgcagccttcttatttgtaataatttgaatctatcccataatcagtaaacctgatctttagttacgtgggaggctttctaccttctcataactatggtgtgaaaatctttcaaatttcagctataataatattaccagaaagaactggaaatggccaggcaaagttctaattactttaagaatattaactttttttaaaaaaagaatattaacttatttggtactcataaaaacccggccggatgcagtgtttcacacctgtaatcccagcactttgggaggctgaggtgggaggattgcttgagcccaggagttcaagaccagcctggacaacgtagtgagaccccatctctacaaaaagaaaaataaaaaatcagcctggtgtggtggcacatgcctgtagtcccagctacttgggaggctaaagtgggatgattgcttgagcccacgagtttgaggctgcagtgagttgtgatcacgccactgcactccagcctgggtgacacagctagaccctctctcaaaacaaaaaacaaaacaagctctatgagtaggtactattatcaccccattttacagatgtgaaaaccaggcacagaaaggttagataacttcttcagtatccaaatctaatgcagtctagctccagtccctagttcattaaacccagaaggatctgaagaaaatcgaactgtcatacaaatcatatggttaaaatggtctatactaaaggtaaatagtttacatttcatgggctctcactgtgtcaggtagagtgctgagtgcttcaatgtattagttaacttaatctttactcataaacacacgcgcatatgcagatctacatgcacacacacacacacacacacacacacacacacacacacacacacaaggtatttactaccattaaccccaatttacagatgaggaaactgaaattcagaaagattaaataatctgtccaagatgatacagataatgaatggcagctgtcatattcaatccagttctgtttattccaaagcccaaacttttaatcaccgtgcaatattgataatcacatgttaaaattatattttatgaaaaatcaatgtatcccaaattaaagagatatgttttaatcaagttgttgaatacatgaaagagcttctaaataaaagagccaaagttttatttagtttttcttttggtttattttattttcccaatcacctattcaaattctcaactaagcagtgtagcttaaaaaaagatgagtaaatcaagagataacaaatgattcataatgagcagcacttatcctcaactttttctattttaaaatatagtgtttattatctctgaacatcatcaggcatttcacaaaaatatgggataaaaataattccattatttgaaggaggccagtagaaattattatagatttaaggaaaaggtttagcaatttctaacactaatctttctaaagcgtggtgaaaagaaaatctatcagctctggagacagagagtaagtctgaacccagctacttattgtcgagaatgggaaggaaggaatgaaggaagcaagaatatttactgaattattgcttgtgtgccaggtcctcactcttttattagacaatactctacccactccactttgcctgaggcccaaaaggaaatcaaagcactgcagggtgggagatctatctgtgacctcttgcagtactttgatttccccctgggtctcaaagtggagtgggtagattattgtcgaattaaagaatgagtacgtggtacacagcaattattcagtaaatattcttgcttccttcattccttccttcccattctcaacacttgttcctacctgcgtcaggatactgaacttcatcctccttcactctgaaacaacagtattcccaaaagattagccccacaatttgggagcaattaaaaaacggggtatggaatttcacaatgtatatatgtttcaaaacatcacgtagtacacgataagtatatacaatttttcgttaattaattttttaattttaaaaaaccaaaggtagagctaaggttatgacatcattaaagttaaaagtacaatataacttcaatgtgtataagcaaattatagttgtgttcaggtagcgaaattgaaaaagattttgaaattgtcttaaaagactttttttggttactttatacaactgatgcagggggagcaaaatcacataatcatttcaatagatgaagaaaaagcacttgaaaaatgcaacattctttcatgatataagcactcagctaactagaaataaaagggaccttccttgaccttataaaggacatctactaaaaacctattgtcaatataacactaaatggtaaatcattgaaatgtactccctaagaaaaagaacaactcaaggatatctcgtcttcccactcattttctacattgtatgaaaagttctagccagggaaattaagaaaatgaaataaaaggcttccagattggaaaggaagaagcaatattattaatatctctatttatagatgacatgatcttatatatagaaaatgctaaagaatatcctccaaaatattattagagctaataaatgagatcagccactttgtaggattcaagcgcaatatacaaaaatcatctgtatttttatacgttagcaatgaacaacctaaaaatgaaattaagaaaataatttatttacaatagcgtcaggaagaataaaacacttaggaaaaagtaaaccaaagaagcgtaagactggtacactgaaaactacagtgttgaaagaaattaaagaagacatcccatgttcatgcatcagaagatttaatattactagatggcaatactcacaaactgatcaacagattcaacataatctctatcaaaatcccagctagcttttctgcagaaattggcaaatagatcccaagactcatttggaaatgcaagccacccaggatagtaaaaagaaatcttgaaaaaaagaacaaaattggtggactcacacttcctaatgtcaaaacttactacaaagctatagtaatcaagacagtgcatagtgacatgaaatatgccactggaacagaattgagaattcagaaataaaccctaacttttatggtcaattgattttcagggccaaaagaatttaatgggggaaagaatagtgtttttaatacatgctattggaacaactggctatacacatgcagaagaatgaacctgaactcctaccttctaccatacataaaaaataacccaaaatgatcatagacttgaatgcaagagctaaaactataaaattcttagaagacaacacagaaataaacctttgccatttggggtgaggcaatgatttctcagatgcaacaccaaaaagaacagattggtaagtaaaacttcatcaaaatttaaattttttgtgctgtaagtgataccatcaaagtgaataaggtgacaacccacagactgggagaaaatatttgcaaatcatatacctgataaaatcttatagccagaatatatttttttaattttcataattcaataaaataaagacaaataattttaaaatgatcaggccatgcatagtggctcacacctgtaagcccagcactttgggagcccgaggtaggaagatcacttgagctcaggagttccagaccagcctggatgatttggtgaaactccgtctctataaaaaatacaaaaattagctgggtgtggtggcacacacttgtagtcccagcttcttggggatgctgaggcaggaggattgcttcagcctgagaggtcaaatctgcagtgagccgtgaccactccactgcacaccagcctgggcaacaaagcaagaccctgtctctatttaaaaaacaaaatggctaaaggatttgaacagacatttctcaaaggaagatatacaaatggccagtaagcacgtgaaaaaaaaatgctcaacatgattagccatcaaggatatgcaaatttcctgtaaatgtaaattcccagggaaatgtgaagaaaaaaagaaaataacaagtgttggcaaggatgtagaaaaattggaaccctaatcccttgctggtagaaatgcaaaatggtgcaatcactacagaaaacaatttgacatttccttagaatgttaaagatagagctaccatatgacccagcaattccactcctagatatatatattcagtagaattgaaaacatgtattcacacaaaacatgtacacaaatgttcccagcagcattattcataatagccaaacagaggaaacaacacaaatgtccatcaactgataaatagataaacaaaacgtagtgtatatccatgcaacagaatgttattcagcaataaaaaaaaggaacatactaatacatggtcaacatggatgaaccctgaaaacacagtcaaagaatcagtctcaaaagaccacacattatattattccaattatatgaaatatgaagaataaggaaactatagacacagaaagtagattcgtagtgcctaaaactggggaggagggatagggaaaaatagggagtggttgctaatgggttcagggtttcttttgagtgataaaaatgttctaaaattaaattgtggtgctggctgcacatctctgtgaatatattgaagactattaaattgtacacattaaatgggtgcattgtatggcaagtgaattatatctcaataaagctattttaagaagaacacacacaatgctgaaacggaatctttaggaacagagagagtgaaaatccatacagaaaataaaacacaccaacatgatgaaaaagagggagagagaggagtggggtggggggggggtgggcggtggtaatggaataggaggagaaagaggagagaaaaggtaagatgacaacattagactaaggtttatttatcacatttaccctcttcctgtagtgaaatatccagctctgaatatctgtaaacggtaaaacagttgcaggatatgatttacaagcaagagttattgtagcaagtaagagttatttccgtgtgtgataataagtcaggcttaagcaaccactgggtcccattcagtgctttcggtgctcctgaaggaacacagtaaaagcaatatagaaaagtaatccccaaaggtttaaaaaaattattttcctccatcttcttctcaaactttcatttaaataagacgtaggtttcatatgattttctgaaccagtgatcagaataaacacatgcccacagtctatcattctgaaacattagaaaatcaaacgatgacttaccttttctaatgtactgaaggacggccaggactgatatccatattcagatgcaaatcgagcttttgggaaaactttccagttccagcaatcactgatatagtcataaaaatgtacatcaccaaaataattgctattagggttttgagagacccaggcttctgcaacagtttcagccccatttgtaggactggacgtaataaaaggacgactcttgtctccctgagttcagaaataaaatgaattcaaggataatatattcatcctgtaaagtatgtatcatttacttctttaaaaatactaacaagtccctgaaatgccaagtagctgatagaaaattagtaggaccacttaccttcttccctattcaacaaccaccagcacctctctgctcttcgccaatcctttatatcttttcataagtaacacttagctcatccctcacagcagctgttcttaatcttttcaatcatgttttgcctccactctcatccatcatgggtggtgtacagtctagtccagagtttcttaactttgacactattgacattttgagctggatacgtttttgttggggttggctggggttgggggtgtcttatgcattgtaggatatttagtagcatccctggcctctaccaaacagatgtcagtacccctcccccaaccttgaaaaatgtctgcaggcactgccaaatgttccatgggggcaaaatcaccatcacttgagaaccacaggtctaacaggtaagaacagaagctactgagtcagatggacccaaacgtgactttaaatctcaaatctgaaccttattatttgtggacaggtctaagccttggtagatttatctgtaagatgaggataataatagtacctcctttagaggtattataaatagtaaataactctcatgtgaaagtaatggctaggtgtccaccaattcatgttctcgtttctgtaatatagagccatccctaggaagtggcttcctagcccatatggggccatgtgcctcattctcatcctctgcccccatttgcagctgagggtgcaagagatggtgcagctggaataaggtgtctatatctctgaaagaggagctgccagcagccctttcatagtgtcagtgaggaagaaatacacttttattatgtaaaccactgaaatactgtggcttacctgttacaacatctagcatgtaagcacttaacagggtgcctagcacactgtgagaactcaaaatatagttactatcatctcagtagatgagactacttcctatttcactgagaagattcattcatttagcaagtattcgtcaagtctattgtgtctggcatttttccacactgcagagggagggagagagacagagaaagagagagagagagaaagagagagaatctatgactctgtcaagtacttatacaacaaatctcttttgagtatttcctattggccaggcatgcagttctttctatgtgctggaggttcagcagacagccatggtgaccgtcttggaagagtagatggcaatttagtgctgaaaccagatactgaacaagtaattataagtatgatgaatattttgaaggaaaagcgcaaggctctttgggaatgtaaaacatattacagaaggccagtaagccttccctgagagatagacttccagaaaataattttctcaacttttcaccattaggtttcactttttcgtggtatatccattcatatttcatttcttgtttctattctgctattaagaaaaaaaaatccttaaccctttcctttgccagactctgtgttctggtcatctttctagtttgctttggtactatagccaacaaactatcttccactccatttttttcttaatctccctctactgcccttttcccttagcttccttaggactccctttatcctaataaaaagtccctttgatcccttgtagtccatcagatttctttaccatcctctcattcctaaacccctgacattcatttcctgatcatttcactccactgaaatgtttttcaaaaattacccatgaacttctacttactaaataaagcagttctttctgtccccacttattccctctcaggtgtgcaataaatgaccctatttaccacctattatttctgaagctctctccactcctggctgtttgttcacaattcttccacattccagtttcccccaaccttcctgattcttccttctccagctaccctctccatccccagatggacactctacctctctctcaggcttctccttgttctacaccctgtcccatggcttcccgtcacatggatgttctgattactcctagccacacctgcacacttgacctcatgttcaccaccacacattgctgataaccagctccacatttccacctgtgttgtcttgccaacatcgcaaatccaaccttttaaagcagaattctttatttactaattccaaacttatctgactatgctccctttcttgctgaacggtacccagattggagtcatcttcaatttctccctctcttacctcccacattcagtcactctgagtagtagcaactctacattcagatatttttttccatcaccgaatttccaatcccacaccactggactccactacctatgacctccatgaccttggggacttaatgactctaaaataaatatatcacctacactccaggtaacttctaaaaattaagtaaataaattatacaaagcacttacataattaactttttaaaaatttgttttttaaaatttaaaaaaaattgttaaaagacagaatgttgcccaggctggagtgcagtggcatgatcatagctcactgcagcctcgaccttctgggctcaaaataagcctcccgcctcagcttcccaagtagctaggactacaggcacatgtcactatgcccaaagaattttttaaatttttttggagacaggatctggctacatcacccaggctggtctcaaactcctggcctcaaatgttccccctgcctcagctcccaagtcactggggttacaggtgtaagtcaccacatccagctttaatttaatatattaatatataataatattaatataataattataattaatatattgatgcctggcatctcagtaacttggagttcttagttgttataactggtttccttgtttagaacctctcacctccctaatctttgctagtaatcttccataaacatggaccagataaagttcctcctctcccccaaaatgtccactagcttcccaccatctaccgaataagctcaactccataatatgatttaaagtccctctatgacctgcttccagtcttcactaccttccattctcccacagtaatccaggagtcccttgctcttaggcaccaggcactgcttgctgctcattatacataccacctactttcacatctttttacctttatttacattgttttcatgacctaaagtactactagacaatgctttgcctcaaaattctccacctgtaaggtttcccttgaatgtaaccttttactcgaaagcctttttagattctttcagttaaaattaatggttctgccacatagttcccagcattttgaagctacattttttatagcactttttttaactgcccaaggtctgataatttttcccatgtttccctttgacagcagagtgtaagctccacaaagataagagtgtcccccacagcatcgggaatgaggctttgctcttggcaataagtactcagtagatgttgggtgaatttaaaaatattaaaaagtatgatgaaactataggtgatactaaatgtttaaaaatatttttgctacaatggctttgaagaacattgaagaagaaggccagtcaattggccttgattgatcaagcttgacagatttcccttcattccttgagattcttgagaaatttggcacgctgagccatgcagtaaaattacaaacaagtctctacctaaaaatatctggctttgacgatgcattataatttccttccacttataaatcctttattcttgaggtgtggttatttgttgcaaatctcacagatgacatctttctaagccatgaccttaaacccttagttggaccaggaaataccataaggtgatccaagagaatggccataaaaagaaagcatgtgcagcaggaaaccaatcattacagccaatttgtagatgaatcaatttatggtactttccctttttatgatgcctaatactttgatggaaactaaaagcagtagtggttatgtagcttttaatactattcatctttgaaaaaatttacaaacatcagttattgcccatggctcgttttaagataaataagtccctaaaaagaaaggcatatctccatttcagaggtaaaaaagaaatggcacaaagaagctaattttttaaagcttaagaatgtagtgttaaaattaatgatcaaaatgtgtaagtatctgaagatctaccttgttgaacaaaagcaataaggatgatgatgatgatgatgacgatggctagttttaattaaaaggttactgtgggccaggcgtggtggctcacacctgtaatcccagcactttcggaggccgaggtgggtggagcaggaggtcaggagattgagaccattctggccaacatgctgaaaccctgtctctatgaaaaatacaaaaattagctgggtgtggtggtgcatgcccgtaatcccagctactcgggaggctgaggctactcgggagaattgcttgaacccaggaggcagagcttgcagtgagccaagaccgcactactgcactccagcctggtgacagatgagacagatgagactccatctcaaaaaaaaaaaaaaaaaaaaagttactgtgaaccaccatctttcagtaattcactacaacgatgacacgcaaagggaaagaggaaaggcacctgatattctctaggccttttagaaaatatggagttgttcctttggccatatacatgtgaatctacaagaaaggtgatgtagacatcagggaaatgcatctggttcaaaaaggaatgccccacaaacgttaatgtgggaaaaccagaggagtctactgtgctacccagcatgctgttggcactgttgtaaacaaacaagtgcaagattgttgccaagataattaatgtgttgagcatattaagcactctaggagccaagatagctccccaaaactcaagaaggaaacaaaggaaaagaaaaagaaggaagccaaagagaaaggagcctgagttcaatggaagcacagctggctccacccagagaagtgcactgtgagaaccaatggaacagagcctgagtttctagaacctgttccctatgaatgcatggcataacaggtgtttaaaaaataaaagagctctggactgtaaaaatatttcttttcattaagcagaaatgtgttgtcccctgccccaaagaaatattttaactttaaaaaaaaaaaagttactatgcgtcagactgagtcatgtgccttccatccattatctcacttagtccacataacagctcttaaaagttagctcctatttttaacctaattttatagatgggaaaaggaggattaagtaactcacccaaggttacatagacaggaagtggcccagccaggatttcaaagcctgcatacttaaccactatgctataaaatgaaaaccctcagaaactataaatccatcaaacatgaaaaacataatatcaatattgtgaataaaaagattataaaataagtgttctgtaaatattttttaaaatttgtatcatcacattttgtgaatagaaaaattcttcatgacacatgtcttagtatatcaggtaaactataaatttgaacccatgtttttcatgaattctcaatgaagtttcttctataaatggaatagtgccataaactgggcatgtttaggtgctaatatcacatactattttaaaaaatagatgccttttcaaattgcttctggatatacccagatatttaaaacatctatttacagacacaaaagtgtaaagacaaccagattattaaatcacatgttaaacaaagtttttcaaaagttaaaacttttgaaggcattactgaaaaaaatgctgctttttctcacaaaaaggccaatttatattaacatatgtctgtataatatgccaattagacaaacagtggtgcaaagagaaccactatagagcaagggccatacagcggggttggagaccagctctctcatctctctttgtcccttaaatcacataccaggacattcatatgtgatatataccaaagtctactactttaacacatacgattacagaattttagaagtggcatatcaataatcatcgaatctagagattctaaactttttgggatccacggatggactccaaggagcatgtgacaacctagcattgtaagcactgcattggtgtatgtgtggagagctgcacagagaagttaatcctccaaaaagtccacagcccatgaatcctttcatctgctgctgcactacaatgggataccctgtattcaaacgatactgttgaagacagccctaaaaaggggcataaaacatactataccagtattcaaacttatccactttaaacatacattcttttttttttttttgagacggagtctcgccctgtcgcccaggctggagtgcagtggcgcgatctcggctcactgcaagctctaccttccgggttcacgccatgctcctgcctcagcctcccgagtagctgggactacaggcgcccgccaccgcgcccagctaattttttttgtatttttagtagagacggggtttcaccgtggtctcgatctcctgaccttgtgatccgcccgcctcagcctcccaaagtgctgggattacaggcgtgagccaccacgcccagccctaaagatacattcttaaattctactgcattaaaaatcattacttactgccagtacgagctctctgatgtttttcacatagagtgtcacatagtccttgatgtagattggccggtcagtgaaactgatatgataccaattcatcatcagcgcctcctcattttcattattgccactccatatgatgatagaaggatgagatttcagtctcttgatctgaaaattaagaaaacataaaatgattttcaaagagttaacataaaaaattcagagctataattactcataaaattaaagcccttgcatttctgcacataaattcttatgtgccaaaaacctaatttgaaaatggctagtcatgttagctgcaggaatacattttaagaaatctctgagattctttttaactagattttataaacactgatacatagggtttctcttctctgctatataaaaactgaagataatataatcccttttttagaaagagaaagaaaaggggaatgaataaactcttcactctgtggattgccacaaagaaaactttcaggaaatacaaaaggcaggagacattatattttggggattggttcttaagagcaaattggacaaattggagttctgtgtgaagaaataaatgaagcaaagcaaacactaccactgaaagaaggacggaggttcctatgcagtcctcactgagatcagaaaaccagaaggggaactagagaaggttttacaaagcaagtgagtactagaggtatgctggcagttaaagacaaatatggaatactctaaaggaaaacagattagggcaatcagggttgatgtctcctgaaataactatcaatgtcgtgtcctgagaaatcaactaacattaagttactgaatgtacctaaatataaaagggaaaattagagaatctacctgaaaaccgtgccacacgaggcctgcataaactgagctcatctgggctggccctacataaagacaaaaggatccacttgtgttatgtttgcactggacagattcagacatgtcccttcttctaatacactaggacatgtgccccagtagagagcaattaaattcctctgagaatggcagagtgagtcaatggtcaagaaaaattcttttggaacatgttttggcaatgttacctcattgatatttataggttcaccttcgctgtgatgcatgattacactgattgccccccactgatgctctcaatgtgttctccattcaagaagctcagaaactcacatagatgaaatagagatgcactgaaggtatattaaagagatatatttcatttttaaaaaaattaagtcttgtgtttttctcagccagccatataaacactatttcctttttttgtctttgtacatgcccaagaaagggacagctgctaccaactgtgactgacatatttatgccactgatgaaaatacaaatataaatcctgaagtggcaaaaagcttcagtagcaccgtgttacacacaaccctcaagctgacttagagttttatggtaagctttactttaaaattttaacaaactttgcatgcaatggctctccttatctttaataatgcatcaaagaactgaagatacataaatgttagattttaattatttatacgaaagaaaactaaaaataaaactgaaatgcttgcaacctgtgtaactacaattaatatgtttacagttattcattcatccattcatctatccactttgtgaataatccacagagtggggacgcagaggggaatgagtcctaggcctcagggagatgacaatcttgcagaggtgacaaatccttgaacaagtaattcaaagtgtgatgtgtgtctcaaaaggcaaaagatttttcccatgcttaaggtaagaggggccaaaggagaacaaaggaggtggctcacaagggcagtggatggggaagatgttccaggacatagacagcaagatggagatggtgcctgaacaggtgcagacaccagctggccggagtcccgcattaagaggatcttacaccttacccagaggtcaagaagccacctcaggggaagtgttggctagggaaggagttcgattgtactttttaaaccttttattttaaaatgaaacacagttacagaaaacaaattatgacacggtcaattatcataaggcaatcacccttgtagccaccacccagtgcagccaggccggaagccatccacgtgcctcttcctaatcacagccccttcctccttccaaaagtaaccactatctagagtatcatagtgtaatagaaatcgcttccttgcatttctgtatggtttttcacaaaatatacatctgcagacactataatatgaactctagattttaacacacttgatggattcaattcattgacatccttatctttattgaatctcaaattgtcccccttttggttgttcagagtctctcaaaatccttttgacataactttgatagcttccttgttatctgcatgttgagatattccaggatcagggttctgagcaggaatgtggtatgacttaaaatgtgtcagtggaagatgactttggcagctctgttgagtatgcacatattgaaagagaccaatgctagggagtccaatcagaaaacaaatgcaatgattgaggagagggaaaaataggatttgaattagagtagtaagcacgggggtgagaaagtaaatacaaatactagtaacattgatatcaaaaaattgtctcaacttaaaaccagatggatgtgggaggtgagaaagaagaaagtatcaatgactttcatatttcctgctaaaaagaaaaatcttgaaagagtgcactggggaaaagataatagatgtactttgaagacacgctgagttagtgtgacagctgctattatttgttatttcttttgaactgcatgacttacacgtattatcctatttaatttttgaaacagtttcatgaggagtgacatcatactagagttatagatacagaaattgaggctcaagaggtaaagtgacctccctaaggttgcagactcaccattcaagaagaaatatcaaaatatttgttctttgtatatcaacattacaaaaaatctggcagacagttggacatgagaaattgaaatcagagtcaataattatccacattgtagctttacctgaggttaccgagaaaatggatttgtttccttctttaacatgttgcagagcactataaaaactcaatatgtctccacagtcttgcaaactctttacaaggtaggggtgatctcctggtgcagtgatcatttccaatggatgctaatgaatcagtccgatgtttcagtagtattttactagcatatgatacactcacaagttggtttctaaactgtattttgggagtacatcataattcagaattttcatgtattgacaagcatcccactctgattctacatggaaacccatgccatgcacttaatatttaggggagaggaaatataatgcaatctgtgtttcaaagcatgatcatcccctaaacagaccttgctgcaaaaataagtatattcagcacacagctcataaacctcagatctgtggctaaaattatcagttgataatattatattaacaccattgccatttgtgaaaagaagatatccaggatcattttatatatttcctgtgccagacctggagtcggccatttctctaagaagcttttctcttaacaggaaagattacttcaatataagaatactcaacactacaacgttgggcattatttctagatcttttcagtaggcagagaaagcatataatcacttccttgcatttatatatctgtgaatataaatataaatgtcaatatgtggaatctaaaataaatcaaggaatcaataatcaatttaaactttctcctgagcaattcaaacagtggtgttgctgtttgctgagatggagaaaacttcagaagaagcaagattggggagggggtgcaatataagtttagtttgtacatgttacatttcagatgcctgttaaacctccaagcagaggcaccaggtaggcagttggatataagaaagaggaattcagcagagaaatcaggactggggataaatctgggagtcatcagccaatagatgatggtaaagccatgacactgggtacaatcacctaggatgtcaattacctggctgtgtaatttttcatgggatttagtagagaacaaaaaccaaaatgaagcaagatttaacaaaaggcaatactaaaacatattatttgttttatttcttcttggaagggtagtaacatacctggtaggcaacttctgctgtcactgaatccaggaagccctgatcagttggataaagggcacaggcaaacataaaatcctgccatacctagcaaatcaaataaaagggaatgcaacacttccataagttttattacacagaagaaagtctttattctgagctctgggcattatctttcacacaaatgaaaaatccagttagcctgatgagtgtgatcactggggcgccattatgcataatttgataccaagaaatgtatcaaagacattaggacttcccagaactgcacaaaatctgagaagagaaaatcctaggcaggtatagaagaaagagaagatggaagaatttgaaaaagaaaaaatgtgtggaggggacacagaatgaggcttccctccagccccttgtcactcctaattcattccaattttcaccaggcatttggtattgagatgcaccagactgttaagaatcatacttcatttataaaggaattagcttttcatagacaaaaggattactacatgcacattttagtaatgaaaccatataagtcccttcctaaggaggctgtgtgatgcaatggttaagaacacagcccctgctgggagcagtggctcacgcctgtaatcccagcactttgggaggctgaggcggggcgtatcacctgaggtcaagagttcgagaccagcctggccaaaatggtgaaacccggtctctactagaaatacaaaaattaggccaggcacggtggctcacgcctgtaatcccagaattttgggaggccaaggtgggcagatcacgaggtcaggagatcgagaccatcctggctaacacggtgaaaccccgtctctactaaaagtacaaaaaattagccgggcaaggtggtgagcgcctgtggtcccagctactcgggaggctgaggcaggagaatggcgtgaacccaggaggcagagcttgcagtgagccaagattgtgccactgcactccagcctgggtgacagagcaagactccgtctcaaaaaaaaaagaaagaaatataaaaattagccgggcgtggtgacacacatctgtaatcccagctacttggtaggctgaggcaggagaatcgcttgaacccaggaggtgaaggctgcagtgaaccaagatcgcaccactgcattccagcctaggcaacagagccagactccatatcaaaaaaaaaaaaaaaaaaaaaaagatcatagccccaaagcagcctgtctgagtcggaatttcattccaccataaatgagttgttagagtttggataaaatatataacctcttcatgtgtcagtttccttatctgtaaatggggatagagaatagtaactacatcattgaatgggcatgaagataaaatatgtagagcacttagaacaatgcctggcactcagagaatattatagaatattgtcatcgtcacaatgaccatcagcattatcattattagaataattcctagtcttcggtggcactctttatattttagaacaacaataatagaactaacagaatatattttctttgctttatcctcacaattgcaaaacacattaaaagtacttaataacaatattagggccaggtacagtggctcacacctgtaatctcaccactttgggaggcagaggcaggtggatcacctgaggtcaggagttcaaggccagcctggacaacacggtgaaaccccatctctactaaaaatacaaaaattagctggatgctaatttactaaaaatacaaaatttagcacatgcctgtaatcccagctgctccggaggttgaggcaggagaatcgcttgaacctggggtggaggagggtgcagtaagctgagattgcaccattgcactccagcctgggcaacatttttaatttttaacaaattaaaaataaaaaattagaaaaaatttagaaaaacaatatgaaacacaccttttctttacttaattttattatttttcttctctttaggtttcgtcagatctcctttaagtgttttaaatattttgttttcttttatatgcatacctaaatatcacaaagaaaattattttaaaagtaggtatatgtatactgggatataaataatttacaggatatctatcatttaaaaataaataattatggtagttgatcacctatggctcttggtttacaagatgccatttattcctatagccccaaatggaatatcattcctagctctgagactggggcaattgcatcattcagaacattggcagtcaaactgaggatatagtaacttatcaatatataaaatgctatcaacttctcaccattattcctagttcatcacagagttcatagaattcatcctgctcataaattcctcctccccaaacccgaagagtattcatattagcatccacaacagactgtaaaaggagccgtaacctgtagaagacattttagaaacaaatcataatttggaaaaaaaaaacagattgtgacagataaacacatttctaatctgttagaaaaacacactctaaaatcatgatggtttggttacaatgtaaattaaagaaagtaagataaaattatatacacattaactataaccacataaaacaaataaacagaaaaagtatgggtgatatctttacctattaaattttcagtaacattattatactctttttaaaattaaatttatgttttatatttagtcttataaaaaatacagttgtaagccttggaaagtatgcactaattttatacaaaccctccaaactataaaacaaaatcaagacttgagtattagtgcctagcacccctatctccttttatgcaatttctccagcccagtatttctttctctagtaaatttcctttctactttttccaattcctattcacattaccctcaggaaaatctagaaacttacaggcagcttgagagcatgtaccttccctccattcccagaacagtgctcaaaccaagtaacaggctgggcagacccagagcactgtgggctcagcacaggcaccacggcaggcttaccaattggcccagttgggctgaaggaccacagccaacccagccccagctgggaggggagaggagcatttgaaaaggaaaaagatagagccaattatcccgtggctgtgtctggagaagaatttcattttcttatgaaatctaaaataatatacacattttaaagtaaaaggaaattactacaacttttggaaaaaatcagggtttagttactgatgacatttacattctaaacatcaaataatatactacaatgcacatttatacatttgtaaatatgctaaaatgttatttaatttagataataaataagtttaaatgtgtttattttcatttcataaagtttattttcagcattgcaaagatttaagtttacagatccaattaggaaatattattttcttccaaagttctattccttcagtcttggaaaaacattttttttcctagatctagaacttttaagattatattttgtttttaaataaattgtattgtgtatatttaaggtatatgacataatgttatgggatatatagatagatagttaaaaggttactatagtgaaacaaaccaacgtacttaccatcctacaacaggggtcccaacccccaggccacggactggaccatggatcaggtggcacagcaggaggtaagcagctggtgagcaagcattactacctgacctcctatcagatcagcggcagcattagattctcataggagcaggaacactattgtgaactgtgcatgcgaaggatacaggttgcatgctccttatgagaatctaattcctgatgatctgaggtagaacagtttcattccaaaactatcccctcatcccccacccccaatctgtagaaaaactgtcttccatgaaactggttattggtgccaaaaaggtttgggactgctgtcctacgtagttatccactcttttttgcttttgtggcacaagtagctaaaatctactcacttatttaccatgaatcctataaatagcacaatttttttaacctatattcctagtgcacatcagatctctggacttgttctcttgcatatctgctacattgtatcctctgaccaacagctcccagtttcctccccaccctcccacaaccgcgcctccactacacacgagattttgtttagttcttttgttgagataaaagtaaaagaatatgcaaataccttagcatagaaaggtaaatatggggttggcccggtggcttacgcatgtaatcccaacactttgggaggctgaggcaggtggatcatttgaggtcaggagttcaagaccagcctggcctacatagtgaaaccccatctctactaaaaatacaaaaattagctgggcggtagtggcctgcacctgtaatcccagctacttgggaggctgaggcaggagaatcgcttgagcctgggaggcggaggttgcagtgagctgagatcacgcgactgcactccagcctgggcaacagagcaagactccatctcaaaaaaaaaaaaaaggtaaatatgtgttcttatctttcaaaaccatgctcaaaacatttaacgtatcatttgaaaagctgaaaatagttgaatgtaatatttttttcggagactattcaaaatataaattactcattttcttatttctccagaataaacatataatagttttctaaaaatcgaatggcttcaacagtctcaaatagtttagctgtaagaccacctgtaacccaggagaatggaatatataatttttaaaatcctgtccattctgaagtttccatcgtctagaattctatactacctcttagttccttgcccagagactaaagaaagtaaaaatgagtaaacctcaagctttgcgggactgctaattaaaagaagaacaagaaaagaaagacaataacttacaactcagaggttactcggtcctggaatgaatctgctgggatccagtttgagccttttagaaatatgggaaatccattaattttgaaatagaaactcaaaccaggagacccttttataggctcttctataagttccactgtcctaaaataaacctgcaatgaacagaattaaatgatgaatatcaaatttaaacataagcaaaatagtttttttaaaaaaagcagacctttttgaaaaactacattcagtagtttaatgctaattttcctatttactatgaagcacataatgtggaaatgcacatttcaggaatatacacatataaattattgctagcatccgttatttctcttttaaaagagaaatatagaaaccactaaagagctactgtagtcttccacatgaaataggcatttgtgataacatcaaaaaagacaatttgaagataacatctctaaattaaaacaaaaacatgctatttcaaaaaaatagaaaaaaatgctgtctttgaaaaacacattctcatttcagtgttgttaaaaggtagccaaacatgcatcttagaatcaaatgttataacttaacaactttgcaatcttaataacacattaccataaaatcactttgtttaatgggtaatttaatcctaattacacattaaactcaatgtttgagcacgctctggtttcttgactggagatgtacatggtgttctaatggaagtagatgcagcaggaccacgcactctgtgctattggtgctctggagaggaagcagaggctccatcctagtgacagcctagccaggttttcccccagttaagcatgggcagcaagaccccagatagagaagctttgacatttttatcaaaatctttattcttgccagccataaattggatcaagtttatataagattttataccaataaagcctagccttaagccaaaagcacacatttctctaacttaaaaaatcagtgaatgaattagtcaaattatttcatgtaataaaagtgtccaccattctcctgcttcctgactcctgactttatttatatgaaatgacaaaagacctcagaattaactttacaagaagatacagaatatgtcctggataaggaggatcttgacacgcgatgatcactcctgcttcagggttgcaaaatgtcaagaatgcacagtgattttcagaggtgacttttaaaacaccatgatggtgggttccaatatctagaacagtgcatggttctttaagtgtggcctggggactccaggaggtcccttggagactgtcagtgtgtccttgactttacttagagtaaaactaaaacattatttgcctttatctctctcagtctctgagtgtcagtggaattttccagagactacatgatgtgtgcctacttcatcactctgacagctaatggaatgtgtgctgtgtattccactgtgatgtagctctgcggcagaggtttatggtatgaagcagtgcattttcagagattaactcagtttgttctcagtacttttactgtgctcttactattaatagctgtctttgattattcctgctgtaatctctgtaccctcattgttgttcaataaattcttactttgaaccccaaagtttcccttgcaacctacacaggagcacaaaaggagtaggtactacttattcctttgtttcacagcaatatttttaagttttcaaataaaaacaaattttaattttaattgaaactcattttacactttaataatattttatcttgttctaaaagaaaatttatttataatacttttttccaatttagggatgaattgtcaaaatgggattagaaggcttaccttctcaccagcctggccaacatggtgaaatcctatctctactaaatacaaaaattagctgggtgtggtggtgcatgcccataatcccagctacttgggaggctgagacaggagaatgacttgaatccgggaggcagagtttgcagcgagccaagattatgccattgcactccagcctgggctacagaacaagactccgtcttgaaaaaaaaaagaaggcttaccttctcaacctataactgcactatctgtctatatctgaggatgctgaaaaaagtgaaactgacatatcagacagtcttttgactcatggaagggaagaatctactctaaacaaactgggtaaaattatgaataagaagtgaaattatgatgaaagccacctttctcttgactttatggatgttaataacttacctttttgtgcgttatgcaatggaacatttaaaaataatatttatggtgccagttaagttgtagtgtctcattgagacaaatcattcacagtatgaagaaaagagaattgaatatttaaacttatacatgataagctcattaaaagtcaaacagtgtttattacatcttttcaaaccagacatgaaaaaacccagtgaagcatcttacagggttagttatgcacccctggctggagaagcacacatactagctgagagacagttgtactgttgacattgcagaatgcttactagatgaaaagttagtcgaggaaataacagcactgccactttgcaatgacagagtaactcgtccaattaagagatttgactgcaatatgaagactggcctgatatctcatctgaaataatcatacttttgctttacaaatgagtgaatctccagatatagatggacttgccagtttgcctgtatttgtctgttatcagcacgataaatcatcaaaaaacttcttttctgtgaatttttggcaacaatatacaagaggtgctgaaatattcaaagtactaaataattttttgaataatatcctgtaattactgtgttaacatttgcactgacgttacaaaagcagtggtgggttaacactgctggtgccttagcaggaatcaaggcagtagctccaaactgctagtagtcattacatctttcaccttcatgcattagcagcaggaaaatgaaaaaaaaacagtttcacttaagactgtccttgataaagcagtaaacattaatttcattaaatcccaaccctcagtatgcatcattttaatatcctgcattatgaaatgagcaatatccataaagcaccattcacaatagatagctggaggaaaagcctctgggccattaatagagttgtatgtaagctgaattggccttgttcacgacactccatttttacttgatagaaagaaggactgacagacaaacgatggttattcagacttggatacctggcagacattctctagaaaatgaatggagtgagcctatcatttcaagaaaaacaactagcagtatttgtggccaaggataaaattcaaactttcaagtaaaaattgggattagggaaaacttgtatctactacctcacggtagtagatactacttaaatacttaaaaactttttagatgacatcagtggtgatattaacaaatgtgatattataaaaggaaatgtttcaacatttggaagatctgtaactctcaagaaacaaacattttccaataaccaatgcattatattacaatatcacataatatgggtaaagaattcacacaaagtgcaagatagacaaatgaattttaatgtaacagagaacaaaaagtttaagaaactatcatttgttaaaagaaaactatcattggttaaaagaaaatccacaatttatctgaaaagactattttttcccttttccaagtacatctgtgtgaggtcagatttccttaatctgtttcaaccgaaacaacatattgcaaattgactgaaggcagatacagatgagaatccctttgtctcctactaaacaagacgttaaagtgacttgctaacatgtaaaactgtcattatttccactggtttttttggtcaatatattttttataaaataagtcatatataaaaacagtcatatgtgccatggtttattatggttatttaaaatgaataagtaaatacttaattctcagttttaatatttaatatggtaaatatcggtacatataacccatataaacaaaagcatgttggggttttcaataacttttgtaagtataatgcagtgctgagtccagaaaaatttgagaatcactactgcagaaaatagaatttatttgtttcttaatatacattaatgctacaaattgtattaactatacaacataacactttccagaatatttttcctttctgtgcaaatgttcttataaaaaggcatctctccctatcccccaactcttgcaataacaagttatgactggggtgacaataaacccaaaccacctgacagtgcctcagaggtgaagtagtaattaccagccacctttccctctgggcattctttcacaagtgaaaggctcccgcttctatgataagtgtcagtaattttccacgtcctctggcagtcttgatagtcacataaaagccttcttctacaacaggtattttacttcagagaaaataatgggttctaaaagatttcttgaaaagacccttgagtaacacatatttgcatccaaagtaaatatataatcttcatatgagactaaaattttttaaacagtccaacaaagcaaattattgtctaacagtaggaaaaaggtataaatacctaagaaactaaaaaatgtgtaagtcgggcagttagaaaattaaaaattttaacttctaaatttttatctatttttgaagtttctattcctcactagatcagtgtttttattagcttcaaaaagatttcattttcaaaatagaaggattaactttaaaagtgcaggatagttgaatgcattctttcaaacaagaattaaggatatctgaactaaagggcctaagaggtacgtgactgataaatacggtactcctcaaatttctttctctggcagaccaaacagatgatatgtaatgaatcattgattcacaaacccaaggctgcttctcagctgtttgtatcagatacttaaaaagctgtaatagcatcactacattttcaaaagggcaattttcttcttaaaaagaaatccacttatttctaaacattgtcaaatgtcaaacctgctaaaatccttttacatgtattttaagagacaaccaaacactgcatttctgtctttgttctgaaagtgctcccccatgtaaaagtattgagaaaacaagctctgggtctccacaaatagctcttgtcaaacaggtctgtgcaggatgacacaagagacattctttgtcgtgcccttgcaatttgcagacagcacaaccagaagttaacagattaacattgacatcggcacagttatgcatccttgtagccagatgtgtatctagtatatctgacaccagataggatcactttttaagacctcctcttccatatgacaaagttattttcaatagaagtaatgaaatgaaatgaataatgataatgtccagaaaagaatgtagacattaaaaattttctttccctgaactttgtataatcacgccagttttttaaaaaagtaaaacaaatattagcgtacaaaaaaggaaaagttaatagattcaagttttgattatattaatatatttaataaaattataaacaaagggaataacatatataatggtatgctatagtaagaaataataatatttgctattttcagccttaccttctaaaaatctgtcaacaactttctcaaaattgatcttctttggacatacatgttcaacaaagggtatagccagctcttttgatttatttgtcatagctgatggaaaaacaccttttattaattttaactcagaaatgttcttccagatgaggccagagatatgcaaatattttagaaaagtattaaacataataagtttggtagagattcataataatcccacatcacattaaactccaaaaaaatgcagtcatatccatgcctttgttcttttgactttcattcaaacaatttacaaatgcctctgaggtataaaaaaaaaaaaaatcccacttctcaagtatttcttctgtaaaatcagagaaaatggctaaatgattgtgaacacagatactatttgattaattgctgtagaacaagtgtccagttctcagggacaacaattggggcgtttggcattgctatgtggatttctctgagcaatggaaaaccagcaactctttgttgtttctcctggcactctccttcaaaatttgattcttttttctatgtaaatgttgatttccttatattttgttgttgcacagtaaataggcttcaccaaaatttctgtgcacttatcttcaaagaagaattttaaagtttggtatttcactgtacattgttcaagatggagtctatttgcaaatatttttgtatctgattaatgtcatctaaaactataccagaaaaaagataattccagagagaaaaccgcacacagcagagagaaatgtctgagctgattcacgtgtccacattttctttggattacatggtacttcagagttgagattaacttttcaaaatttttctactgtggcccagcttcataatgaaccttccatcttgtctaggaaagcttttctgcagcttttcccatcaatgaggtgagatgagaaagaatgaatacaatttgtccaaagttctaaaaaaaaaaaatcacacaggaaaaaaaaagtttccaaaaaagcaaattccacaaggctcagagaataatttccaagaggctgaaataaaattttggattaatttctttgatttttgcatgaactccacagtgaatactggccacatatgcagcatcttttatcctggcccatagcagaggtttatgaaataataatcccattccttgaagctattttctgtgcattctgcagcagttgttctggaaatatgagaatgactcctttatctccattctactaccttccctatgaccagttcacacatttgatctctgtttccagaaaggtaagaatgacttctttatttccactctgccaccttcaatataggcctatctgaccaattcacacatttgatctctgtttaaagtatccagagtgctgtcaaaaagaattccagccaggcagtggctcatgcctataacctcaacactttgggaggctgaagcgggagggttgcttgaggacaggggtgtgagaccagcctgggcaacatggcaggctgtgttgcaacacccacttactgtctgcacctaaggctaactactccccatctctagaaaaataaaataggcaaggcatggtagcatgtgcctgtagtagtcctagctactcaggaggataaggtaggaggatcactggggcccaggagttcaaagctgcagtgagctatgagcagcctgggtgacagagtgagcccctgtctctaaaaagaacaaaataataataataattctaaagcatttttttcagtatctgccaccccctactaaagcataccactgatgtcatgttttactttgactctttctttagtttcaaaacaacaaatttaaaaaaataaatttcaattctaaagacactattaaaattagtagaatatacttcatacatgaactaaaatatgcacttaccaagcaaaatattacacattacacctcagagtccatagctttctcaactgtaaatttaaagcataaaaataactccaagagatcacatcgaattgaagtaacttatgttgagtttctccttttttataatcactgtgctattgttgtttatttctaatctgcaatgcttttaaatgcaggcatgtatagggcagggaatggaagcacaaactgtgttcaaaacaagctcatacaattccaaactgttataaatttgctttcaaaatgactgtatgaagctgaatcttcatgtatccgggaatgactgtataactaagagtactccaggccaggtgcagtggctcacgcctgtaatcctagcactttgggaggcagaagcgggtggatcacctgaggtcgggagtttgagactagcctgaccaacatggagaaacccccatctctactaaaaatacaaaaattagccgggcatggtggtgcgtgcctgcaatcccagctactcaggaggctgaggcagaataatcgcttgaacctgggaggcagaagttgcagtgagccgagatcacgccattgcactccagcctaggtaacaaaagacaactctgtctcaaaaaaaaaaaaaaaaaaagtactccaaattaactttcatgtagaatataatgtctattacaggactggtaataaaaatgtgccaaatctaagcatacatgtatattattaacattcaagagtaaccaaacacatagttaaaacttagaccaacatatgattggtggagggggagggtaggagaagtattctatcactggcattatttattaataggattgccagtatatagtaataatgaaaaacaggccaatctatagtctacacacaattcacccacttactgtctgcacctagggctaactgctcccaaggcccacctggagaagtcactgcctatagccatcttggaaatatttaataaaacttctgacaagaataaggccaaaaggacagtgtactgggttgaacagtgtccccccaaaattcatgtccacccaaaaatacaaccttatttggaaataaagtcttcgcaaatatatttagtttagttaaaatgaggtcatactgggccctaacccaatggctggtgtagttataagaaaaggaaacaagagacacacacaaggagaaagctatatgatggtggagacagagatcagagtgatgcatctacaagccaaggattgccagcaatgatgagaaactggaaggggcaaggaagaattctttcccagagccttcggaaggaacacagctctgccgacaccttgattttggactccagcctccaagactgtgagaaaataaattttaagatactcagtttatagtaatttgtaataatagacctagaaacctaatacagaaggagacacacttcataatctctgtgccctctcaatacaaaaatacaccttgattattcctaattccatatctttggctatgtacttttaaggtctttagagagccaagagtagcacttagaaaaaattccactagtattatgttggttttttgccctgtgcaatttgcaaagatgaagacaggaatttaagaaacaaagaacaaagtgacattaaaaaagaaaaaaaaaaactgaaaaagaaaaaaaaatcccaattgtttttctaattgtagtagccatggacaatcattcacctcctctggcttgggaactatgaaacacaagttttaattgattgtagagtacttattattacatctattttcctacaataatttaattggagaatcttgatcccaggagcaaacgtacacagcaacagccttctgctgcttttagcaaaacgataccttatacatagaatacttgagaaattcttataaaataaattaggtgtaagagaaatatcaactaattggtttcctgtttttccataaaggcaagccataataagcattcaaaaatatgtattagttcattaaaacacgttacctagtcaattcagtacaatcaattagtaggataaaaacactcagttaacctgggcagaaaatggcaaaaactgattggtcagattttttattccatttacccagagtatcctctaccattcccacttatacacaaaactttttcttttgttaaaaaatcaatttggtttcccaaactgataaagctaactctcccagactcacattctaaggtccctcaggcaatgatttatttggcagaatttatgatatcccaacatttattttttattttgttatttattaatgtttaaattgcctgttgatattttccctatattacctcccttcttgcttaaaccatttgccccaatgtcactcaacataagaaaattctcagtcatcaagatattctgccatgttcacaaagaaatgtagtcggccctttcctctctctcaagtgtctgcattcttttcatgattccatacatttctgctgtatgggctgcattcaaaatctgtaacttccccaggaccttttgtctgagtcagatatgctgctgtctcctgatatactcagttaaaaaaaaaaaaaatcctaaacacgtttctaagctcagtggaagaggagaggcatgaaacaaagatataaaactgaagcaagatggatttcaatgaggtatatttaaaacagaattatttttgcataaagcaagcccagggtaacaataaacaagagcaatagaggtgaaataaggaggggctggtgatgagaaaacagtgttcaatgtcctgtctgacacagtaccaagtgctggcgagcatgaggagcctaggcaagtctcatataaccactttggatggcagtttagcataatctacaaagctgaactcatgcatcctccataatcatgccattccactcccagcagacatgccgttgggggcatatgtgctccgagtgttatatcagtaatgttcacagcagcattacttggaatagccaaaactggcaactactcaaattgcaacagcaaaatgtgtagtataataaaattttatacaacttaaatagacaaacttacagttacacagaacaataaacagcagtccccccttatctgcaggggatacgctccaagacccccagtaggtgcctgaaactgcagatagtaccgaaccccatatatactatgactttttctgtctgataaaggagaaggctgctgagtgactaacaggtggataatgtatacagcaaggatatgctcaacaaagcgatgattcatgtcctggacaagacagggcaggacagcacgagatgccatcatgctacacagaacagtgagcaatttaaaactcatgaattgcttatttctggagttttccatttactattttcagaccacagttgaccatgggtaactgaaaccacagataaggaggcactactgtacctaaatgtcaaaaacataatgctgagccaaattagccacacactaaaaaatacatgctatatggttccatgtacataaaattcaaaaagagacaaaagtaacctagtgatggatgtcaggatagtggatcttcgggaaggaaacaggggtcattactggggaggctcgcagaagggaggggagagtttgaggtgtgaagtgctagtaattaatgttctgtttcttgaacatgttgacagttacctgagtgttcattttctcataattcattaagcttttcacttatggcttgtgtatttttctgtatgtgtcatatttcacaataaataaaaaataaaatgttgtttgaccaaaactccctagctttctttctcaggcttactttttcaccctaaaactccactgacaaaagtgtttgccagtcttatagaaagaaaatatactttaaatggtcctagagaccttcaaaattacctccatcctcaagctgcatcctttcctcccatgtgttatctttcaccactattacaacgaaaacagagccccccatcccaaagtgaatccatcctcttcttatctcctacctcccagagaccttgccctctcaactacctccctgctttctaactctttttagtctttccctcgctactggcccctttccatcaggattttgctgttgctttccattctcttaatggtatccttttctatgttgaaatcattgcaaacttgtaataaagttccaacaataatacaaagaactcctatatataatacaaagaatccagagacccccccattcaagttttcatcagttgccccaataacattatgacaaaaaagatcactgcactgcacccagttcgtacatagtctcttccactgtaggacagttcctcaatctttccttgacatttttgaagattatagtagattgaagactgaagactgaagactgaaggcccttgtgtcctttcaatgtgtcacattattattgagtacctccttacttcctggaacagcaagatatttcaggctccagctcgagaatcagtcatttctccaaagagccctgattgctttcagcacagagtggtattccaaatcaacatatgggtcctaaatctactcactgctactagagagccactcttcccaggcgctctgagaaaggattaggaaatgtgtgaaaagaactaggaaatgtgtgtgtgtgtgtgtgtgtctacccacacatacacatgcatttacaaagacatttatttctctgtctacacatactgaaaatcataacttcatactattagctccaatttgaatccactgtagctttccccccttctatgttgataccacctttctccattcatgaaaaggctggcttccaccacttcaatatatttacttatttgttcagttgcctatgtgaagccaatctgatcccaactggccaccattaccacctggtctaagcatagtttccaatcagacgctttcagaagagttgcctatattcaccgtctttacttccataccttgagtcattcctcaacccactacaatttgatttccatgctgatcaaggtgaccagtaatctccttgccaccaaatctaaagaatctttctcaattcttttctaacttgaactcccttgcagcattcaacactctgaacattctttgcttcttaaaacactctttccctctggtttctgtgactccccactcaaattggttttccctccacctcgtcaaccattccttcttagattcttctactggcttctccccaaaccccaaccttactaattatgactgcctggggttctgtcctagctcttttctctgtgccatccctgaggtatttcatccgctaccatggctacaattatctacattctgctaacttacacatctatatccttaacccacatgcaatccctaagcttaagatctatctaatgaaacacctatcaaatattattccttgggtgtctctcaatcaccccacacaaaacacatctaacactgaaataatttccacccaaccccttcccccaaaccttctcttctttctgagtaatgtaactcaatgaacagagttgccctgcctgttcagaggctgcctgttcagcagcccaaaccagcagctgaggaaccattcctaactccttcttttttcccacccccacatcatcaagcctgctgaggttatatcctaaatctctttcagatttatttcctcagcagttctgtagaccaaccaatcctcattttttgtctgaatcaccaccacagtcttctaactggtcccctactcttgccatccttccaatctgatctacacaatctttgtaaaatatgcatataatccttaccccctccttaaaatccttccaagaatcctggcagcactcaggacagtgcttcttccttcacgtggctcactaggccctgcaggactttgtcctagctacttttacaacaccatctcttgttcttcaacttcaaactcaaccacaactgcattgaaatttctttcacttctgcaaacacacaacatcctttctagtccttgggccttcacgttcttttccctccgcctctttgctacattacttggccaaattctacttatccctcaggacacaggctctgggaatcttcccagaatgcccctgctctgcacttccatggcactctctacatctctagagtgctaatatattccaatggctcatttaatgattgaacttcccaatcagatcattagttctactaaggtctcagagagaaacagaaacagtgtcttagtcacagctctatcaccagcacctagcaaaatagccaaaacacagtaggtgtgccctaagtatttactgaatgaatcagcctcaaaaaatagcaactctacggcagccacagccaaagagcacatttcacacacatgcattaactcaaggtgtggggcagttaaacatcctccttaaagcaaactcctgttgctgctcgattcaaaggctggcatctttatgtgtaatgaacaataatacagtcatattagcctgaatgtaaaagaattatttcccttagaaaaagacagaagttcctcttctttctctgtagtaagttggaatgactcattattttttacattttcatgaaaacaacacacaacaaactcactgtgtgagacagcacacatcctctcagccaagaggggtacgacaagagtgaatgctttggcccttaagacgggtccaggatgttctccctgtacataactctgtgcatgtgtgcgtgcgcgcgcacacacacacacacacacacaaacacacatacactctcttcccctctcacacacacatacacactctttctctctctcccctccccccttacacacacacacacacacacacacacacacattcacagtgtctcagaaaatacacagcatgattgaacaaaagaaaaacagaaaatgcactcctgaaggacatatctccatccttagcatgttgtctggcccacaggagaggaaataccaaatgtaagaggtgacaccagccaactgtaaacaccgaagctggtgtctgggagaggaggagatctttgaagagggttaataccatttctactaactatatgccatgactcttataagccagatccaagccatctcgttcttattgtccctattttacatattttgagattaagtaagtagcctatagctaataaataacaaagtgcagttctttccaattcctagtgctatatcctaaaatgggtaaaactgaaaaatcagaaaacaccagtagaagcaccttattcagaaaaatgaagaagaatgtcagaggaaataaataaaagttaaaaatggttggttctggggagtaggaagtaagaataggaagtgatgggcaagaggtcttatttttcatataaacttactagtaatatttgagttttaaaattacacatgtattattttgatataaggtacaattttaaatcatagcaggagactacttattgacaaaataatatctaaagtatgatccatttaaaaatataaggccgggcgcagtggctcacgcccgtaatcccagcactctgggaggccaaggcagtagatcacttgatatcaggaattcaagacctgcctggtcaacatggtgaaaccccatctctactaaaaatacaaaagttagctgggcgtggtggcgggtgcctgtaatcccatctacttgggaggctgaggcaggagaattgcttgaacccaggaggtggaggttgcagtgagccaagattgcaccattgcactccagcctgagtgacagagcaagactctgtctcaaaaaaaaaaaatatatatatatatatatatgtgtgtgtgtatatatatgtatgtatatatacacacacagagagagaagcttttgaatgctgttactaaagatgatctctgatgggtggggacacaagagttttgacggtttcttcttttcccatgaagatctgtattactatttttaaaagaaataaaattatttcacaaaatattttaaattacttacttaccttagctgatttttcaatatttaagcctccatccagttcaaaaagaacagtcatgttgtacccagtctggtttccatgtccatgaggccaccaagtttctacagtaatattcttttaagaaaatttaaaagtcactctaatatgtcatattttcagcaaaaaaggctcaaagcattacatcaatttctcaaatagtcaagtacaaaactctaggttctaaaacaatgtaagtctccccacctatattatgcccaatcagaccaattcattgataatatttaaaaatcagcatgctgggaatctagcatggatcaatacatcaaaagcaaaaggaaagaacagaataacatgagtgttcagaaaaacaactctccctatccctaacaccgagcttacatttattccacattcttaacacttaaaatgggactctgaagttgactcttctttcaagccaaaaactaaaaatcattttgagttcttactttatctcaacagctactgaatgttattttgctccacctttttcagtacacaattatcaattagaggaatagaaaaaagaaaaagaaaagataaaaataatccgttctaccttgatatatgaaagatcatgagtttagaattaaaattgtgcatgtagaataagtatcaataatcaaaataattgacaagtatcaaaaataaccactgctatttaaatataatccatagaatgtattttggctttaggatactacaaatactacagaaaattaaaatacaatgataaaaataaaatgagagaaagaattgccaaattaataatatattctctattttcttaatcttaaagtttgggaaaatcattctttagctcatactcacagaaaatatatgagagactaaaatagagaagaaaatgacaaatataagcagagaaagtagaattttctttcatacttagtccctcctttctaatcatttctttagcacaggtattgcttttcatccagtgcttctcaggaagtaccatcatttaccttgctaatgttcacaaatagctcaacaatccttttcccaggttgaagttcaatgctgtatgtctgttgtgtttgcaacttagggatggctacgatcacttgaccaccaactggctttgagctgacaacatcaaatgtagactctatttccagattccactcctgggcactcttatctaaaatataaaaagaaaaagaaatatatatatatatatataatatgctaagcattatcactgcatttctcaggattcattgaaggtaagactaaagcagcttcaaacccagtatgtgctccacaatgctgtcataatcaaaacttcgtggaaattttcttttaatcttcagtttaatccttcattctgaagaagaataacaaaaatggtatattttacatagacttccactctaaaaatgttatgattgtaagtcataaaaactttatggagcataaacagaaaatgacaaatggaaagataaaataaattttccaagaataatacacatttgttcctttttaattaagtaaaaatactttataaagtaaaaagtaatagtattttactttataatgtaaatgggttttaaagttatgtaataaggtataaatttatatgtattaaaattaatcaaatgtgaaaaaataaagttatactttaaatgtagataatttatccaataaatatttcctgaggactttctatgtgccatatactctgctaagtgatgggaattaaatggtgaccaggataaacatggcccctactctcatgaactaaaagtctatagacaaattcaaaagcataataatatcaggacaggagaaataaaaggttgtcctgagaaataaaaacaggacatcagaaagcacagctaatacagagagggtgaaggaaggctttctctcttttctttttcctttttttttttttttttgacacaggttctcactctgttgccccgggagtcacacaatcatagctcactgtagctttgaactcctgggctcaagcaatcctcctgcctcagccttctgagcagctggcactataggcatgtgccactcacctagctaattttctttttactttttgtaaagatgaggtctcactttgttgtccaggttagtcttgaactcctggcctcaagcaatcctccagcctctacctcccaaagcactgggattataggcatgagccaccatgcctggccaaggaatgctttcattagaaagtggtatctagctgagaccagaaggatgcctcagctaagtacagaggaagatgataaggattctgggcacagagaagcatgtgaaggcccatgagtgagacagcaatgccataacaaggaaaacaaggaacttgggcaataacaaaattgatgagggggtcagcataattgaaaagttgagcacggtccaaatgacactgggtcttttcgaacaggtaaggagtctggcaatttcaccccagatcaatgcggagtcattgaagatttttcatcaaagagcatgaccagatctgcattttataagaattgctaaaggtcccagcacagtgatatacaaggatgaatatgaaagaagcagaaagatataaaatctctctgtgtacaaaaagccccagaaaatgccacttggaaaagccaggaacagagaggaggcaaagaagagtgttgatcagaaagaagagaaaacaagaccgaagaggagaattatagggaaagaagaaagatgagggatgaactttgggtgcagagtttggggttgtcagaatgtttcgaagaggttttgaagtagagttttatatacgcgcagtatgactctgtcctccatttcctgtcaaatttatattgtttgtataatgtctccgggtttggttttgtgtttagtttttatttttaaacaagatagagcactgggacagacttgggacaagagctgggtggaaaaacagaccgttttttaaagttacgcagaagaaactggtcatgagatctcaaaaaagcttggaggtacagggggttagagtcagcaaaaaaagttctcattctttgctgccacagaaagaaaggagaagagcagtgactgtgcagaggcatttaagtttctatgattcgtggcaaagtatggagggagttcctatttagtggcttctatttttctccaaaggaaggggagggggaaggctactagctgagaagtatcttagagacctttctcctacaaataaagaagagattaataatcatggctttgctgcaaaagaaaaaaaaaaaagctaggtttctatgctgatcaatgacaaaagacgttataaccggcactgtttacaactgtaggagcacaccaggcctgttctaaagatgaccccagcacagtttatcattcgcatctcccatcagccaaaagcatagatttgatgcacattgaagtaaaattaatcctggacttaagaactatttttgtttattaagtgatttattctgagaaatactagtcgatgagctctgagttaggtttgttctgatccagttaattttgcaggttacttaccgatagcctccaggttttgaatctatcagctggtagatcacctagtctgctcgctcaccagtgtttaatttcctctattcaataggttgtcaaactatggtctttgggacaaatctagcccacctcttgtttttataaataaacttttattggaacacagatgttatggactaaatggtggactcttcccctaaaattcttatgttgaagccctaacctccagctttttatgaagtaataagggtggggcagtaatctgttaggattgcagccttataagaagaggaagaaacagatatccgtctctctctctactatgtgaggacatagcaagaaggcatctgtctgcaagccaggaaacgagccctcactggaaaccaaatgggccaacacctttatctcggacttcccagctgccagaactacgagaaataaacttctgttatttaagccactctgcctatggtattttcttagggcagccagagcagactaacttaatagtcatgctcatttgtttacttattgtctttggttacctttgcaatacaacagtagagttgagtagttgtgacagatgcctaaactattttactatgtgatccttaagagaaaaagtttgctaatccctgccctagaatattacccccaaaaaaggccattccaacctttctttaaatatctctaatgacaaaaaaacctctgcctcacaaaatagccttcccatttttgccaggcttggctattgtaaagactccctttacactgaatttgaaatatacttctccttaatatccaactaaagattttagctctgtcctttgagcacctcctaccaacgaagcaggctcctgtgttgttttctgttacttcttctttagtaggagaatcagctgttagtgacagcctctgacaggaaaacaaataatgcaatcctcaaaggtcatcggcaaaattccccagtttctcttgctttgaacttggaaggttctcgagcaagtccgcactcctccagagcatcacccgttaacacccctgggaactactaaatgaaaaaactaaggttgtagaattaaaaacacagtatgaagatctacaagcctacaaagttatcaccagatatacttaataacatatttttcccctctcctcttctttcaaatagagtaaaccccttccttccagtagcacatggaaaagtaggtaatttaggttcacaaggcgcaaagtcttaaataaccagtagttttcctgatgttctttggtcactccttttcacttgctaaattaaatttataaattgcataatcctatttgtagttaagaagaactccatcttataaattaagccccatttctagaatacagcttcctatcatctctctcctagcattaataagtcaccatgtcttgaagaacacttatcatcaccagctctcctgaagtaaaatgcaagatcacttcaaaaatggatgaagtactgggggtgagggcaggaaagaaggattgctacatcttctagaatcccctacagagctcatccttccaatcacaccaccaagttctgcatcctctcttcactttgactaaacaactcagcacaaagaggacaggaattctttatcaaaacaggtgcaaaggcaatgctggcctgccctctccacaattcaaggccttgaggccctccctggcctgaaggcttattggtgtcctcgctgatgtcctaagcccaagcagaagagattatgttctacagtttgttcatataacctcaatcaggaaggcaacccagaggatggtagagaatgtggttctggccactaattcgctttaaggttttcccagagatgactcagtgagtgttctttaaaaaaagaaaaaaacaaagagcacaatgtgtctgacctggatgggaatttgtagaaaggtaaacagctacatagcctagattaatgtatactgctccttcgttcagagtatcacaagacaactctagctcatgtagatgtgtccagtacatcagccttcaaaatcttctcaaatacgccagcttcctcttatattctcatacagtctactcctttattaagatgtagttggaggggggacaaaaagccaaaaaaaaagaaaaaaagctttattcaattgtctaggagaaaaaggtataaggagagatatagaaagtagaaaaataagaggactcagttacattacttcaagtttgtcaaaaagtaacaggaagacatactcccaaactatacactgaaccttgctttaattgattgtaataaagactcaagtatcaatgttttcatctagtcatgtgatgtctagtttcaagaaaaactgggttgttccatacttataccctcattgggtggtaatgactattctaacttacaaacaaaggaaaagaaccacaaaatgttcgaggtagaagaaacttggagatgttctcatcactttgcagatgtttctgaggccctgactgcagcacttccctcttgagccagtggacaggccaagggtccaggtttcctaactctggtgctctcgactttccatgagcctctcgcagcgatgcctaccaaaaggaatgacactcacaggtacacaacgattgacatttgtatatgaataatgaggaaaagcaaaagcaaaggtactttttgcctttcagagtcctaaagccaaatgtcgaatatattcaatgtaaaacaaagcattctgggggcactgtaataataaaatgttagcctaagagggtctctgtaaaaaaagaatactgaaatgggcagggtgtagtggctcgtgcctatagtcccagcactttggtaggctgaggcaggaggatctcttgagcccaggtgtttgagaccagcctgggctacataatgagaccccatctctaaaaataattttaaaattagctgggtgtggtggcacgcctgtggtcccagctacttcagtggctgagatgagaggatcgcttgagcccaggaggtcaaggctaatgtgagctgagattgctccactacactccagcctgtgcaacagcatgagactttgtctcaaagtaaaaaaagaaaggacactgaaatctacaaacatagagaatatgtctgaccctctgctaaacgtgtatttatatgatgccacagttcctgtacttatcaaaatactgtctttgtaacctaaactagctgaaaaggcactaaaatagttatgtgagcatttgtgtcaagcaaatgaaatctatttcttgaataactactgtctgtaaaaccttgacaggcattataaattatatcccaatccaaaaaggcaaatatgttgtctctaactctctgaacatatttagaaagataaaatatacccaagtgtcgcagttaagaatacaggatggcatcaggaaccataaggactagcagggcagtgaaagttcagaggcagggcacattcaagtcagcaagggatgaatctgcaaacactggtagatgaaaaagatgcttcatctcactggggggaaaacctattcaaagatagctgcctggattagctttgccctgctgagctcctcacagctcccccttttgcaggctctcttcttcctccatctttaatagagtatgaaaagctgcagggaaaggtagttatgtgcatttaaagaaacagcaatgacaccaaatgaaatgaacaagccatggaatttataaattcaaacattagatattttccggtactcctgccagaatcatgggacagacttaagcagctgcttttcaaagagctaaccattgcgttagccaaaaatgttggcccacagttagttaaaacagctgttttccctcttcttcaccaagcagcaagatctccttacctactcagcagtacaaaatccttgaaactgaaatcaaggcaaaagagacgcaaggcaaaatgtttcctagaacaaggataagttagtaagctccaaagaagaaaatttactcaagcaatgaggagactaatcacaggaaaaattattcaagcaacctaccctctctatgggtatttcaagcaaaatacccataaagttattttcaaggattattttatggaaaaaataatttaaagatgaatgaaaaattgattccaaatgaatgcattaaaaaatgcatgcttatcaaataagcaagactgacaaatctttattttattttatttttttattattattatactttaagttttagggtacatgtgcacaatgtgcaggttagttacatatgtatacatgtgccatgctggtgcgctgcacccactaaacttgtcatctatcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttagagcagcatgatttatagtcctttggatatataccctgtaatgggatggctgggtcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgattgccattctaactggtgtgagatggtatctcattgtggttttgatttgcatttctctgatggccagtgatgatgagcattttttcatgttttttggctgcataaatgacttcttttgagaagtgtctgttcatgtcctttgcccactttttgatggggttgtttgtctttttcttgtaaatttgtttgagttcattgtagattctggatattagccctttgtcagacgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattgaatagggaatcctttccccattgcttgtttttctcaggtttgtcaaagatcagatagttgtagatatacagcgttatttctgagggctctattctgttcccttgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaggaaagtcattggtagcttgatggggatggcattgaatctataaattaccttgggcagtatggccattttcacaatattgattcttcctacccatgagtatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggccctctgtttgtctgttattggtgtataagaatgcttgtgatttatatacattgattttgtatcctgagactttgctgacgttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggaatggtgagagatggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctatagagataatcatgtggtttttgtctttggttctgtttatatgatgtattacattgattgatttgcatatattgaaccagccttgcatcccagggatgaagcccacttgatcatggtggataagctttttgatgtgctgctggatccggtttgccagtattttattgaggatttttgcatcaatgttcatgaaggatatgggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcagctgtaaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctaacggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctaattcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaaaaacatctttatttctgccttcatttcgttatgtacccagtagtcattctggagcaggttgttcagtttccatgtagttgagcggttttgagtgagtttcttaattctgagttctagtttgattgcgctgtggtctgagagatagtttgttataatttatgttcttctacatttgctgaggagtgctttacttccaactatgtggtcaattttggaataggtgtgatgtggtgctgaaaaaaatgtatattctgttgatatagggtagagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtggaatttatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgggagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctccatggtctttacattttggcatgattttgtagcagctggtaccggttgttcctttccatgttgagtgcttccttcaggagctcttttagggcaggcctggtggtgacaaaatctctcagcatttgcttgtctgtaaaggattttatttctcctacacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggcaaagttctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcgtctaaattcttttcaaagtttttaacttctttgcctttggtttgaatttcctcctgtagctcgtagtttgatcgcctgaagccttcttctctcaacttgtcaaagtcattctccgtccagctttgttccattactggtgaggagctgcgttcctttggaggaggagaggtgctctgctttttagagtttccagtttttctgctctgttttttcccaatctttgcggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtagaaaccactatttttaaggactaagaatacagaaaagaaacatagatatatacatatatataagtaaatgaattcacaagaatttcacgttaatttttaaatgtttaatagccttctttctgtcatacacaagttagggaactatggttggtcctttgatcttcaggagtaaactcactaattttaagtcaagatataaattgaacacttgaaaaagcacaaagatgacagtatctctttctagcctcaacagggggaaggcagaaagtgtcccatagacaaattagtttaggctttcatatcaagttagctgaagttactagactaaattagtttgttttaataactactttatccacttactgcatatacatatatataacagatgcccaatatagaaatttagaaaagacagttacacagaagaataaaatgcaaaccatttttaacactactacagagatagctactgtttgcattagttgttgtttgtttacttgtttgtttgtttttgagacagggtcttgctttgtcacccaggccagaatacagtggaataatcatagctcgctgcagccttgacctcccaggctcaagtaatcctcctgaaactgcctttgcaaagttataactgaggaaattatgacaatgaaagaaatcagacctaatctactccatcttgcttgtaacatttaagctgttcttattcattcctggcagtaggctgaactaactttgggaaggaattcagttcatggtttgactctgaaacaaaatggatagcagccctttcccgaaaagaccccttcttgcctggggacgagtctgcctttgcaggactaacaaattagctacaagattagaaattacagtttaggggtcatgcaacctctggctccaagagtctgaacctccccaaattgctcctggggataacatcactattgtaaaacctagatcagtgcttgagatattctgcagaccctgcactggatggatcagctgacaccacccagactggtaatctggctcaaccagttctgccatcccactcaggaaagaagacagcaagaaaaccttacttcgttccccctatgattccatctccaacctgatcaatcagcactccccactttgcaagcccctacccaccagattatctttaaaaactctgatcccacccagcatggtggctcacgcctgtaatcccagcactctgggaggctgaggcgggtggatcacaaggtcaggagatcaagaccatccccactaacacagtgaaaccccatctctaccaaaaatacaaaaaataagccaggcgtggtgtcgaacacctgtagtaccagctactcgggaggctaaggcaggagaatcacttgaacctgggaggcggaggttgcagtgagccaagatcgcgccactgcactccagcctgggtaacagagcaaaactctatctcgaaaaaaaaaaaccaaaaaatttgatcccaaatgctgaacgtctggggagactgatttgagtaataataaaactctggtttctcacacagccagctctgcctgaattactctttctccgttgcaattcccctgtcttgataaatcagctctgtctaggcagcaggcaaggtgaatttattgggcggttataatcccacctcagcctccgaatacttgggactacaggcatataccaccacacatggctaattttttttattttttgtagagacaatgtctgctcaggctggttcaaacttctggcctcaagtgatcctttgaacttggtctcccaaagtgctaaagattacaagcatgagccaccacgcccagccttgcattagttttgacccacctcatttcacacttaaattttaaaaatgaatacattttattttaaataaaaattatatgtacctttttttattatgaactaagcttttttaaaaattttcagtaactctcacagtgcctgcctcatagtatataccaaataaatacataaaagtatccagaccacattagcttattcttttattatttttcaatgtttaaacgtctattgatatcagtgataactgctgtcttccagataaaaattgaaaaaaaaaattctggagaaactcctaaaggtagaactcttttaatgctctcatgagcttacactctaattttattacatcaaacaaccaaattgataactataaaattaattagaaatataggaattactgcttaacatgcacaaagcacatcttcttaacaggaaacatatatttctctatgttaagtacaaaatatattactgtcataatatttcaaaaatgagggaggagcttcaagatggctgactagcggcatctggtatttgccacctccacaaagaagaaccccttcagatagatcacctatcaaaaaacactgaaattcaacagagaagtgacagaaaacacctaaggtaaggaaggagagaaaaggaaggaaccctgcttagcagggaccagctgaaagcctggagaggctccccaatgctgggagaaggtaagtgagtggcctccagtggtctacattcccattatggactcctgcaatcctagccatgagagagcacctccaccctcgcagcccccaggactagtatagggagctacaagatatgcaatggcattgctccagagagggagctcctaagcggttaaagcaaggcaccattttgagagtctagccccgaatggactgcaggctgactttgggcttaatagcccctacatctccacattcctggagacttactgacatccccaagtgtagccaggcactgctgctggctgctgccaccaatgctgaagcaactccaccccctcaggagcagggctgctgcacatttcaaaacaccctgtggaagggctaccctgcttatctccactacctggagcgaaagtgcatgctctccagtcacctatagctactgccactgaaagcaaccccatcctccccaggagcagggcagcagcacagtcactactgcccccacccaagcattccaccagtggtctggatatcatcccatgcctgcctaccacagccagctcccacatgcaccactagaggggtctgaggacaggcctgccctggctctacactcccactcagtgcctgagcaaatggtctggaagcctggggatgaccctgccccatccaccactgttggtacctcagcactcctcccaggagcctgaggacaggcccactaaacctgcagctactaccacagctaacatctgcctgcatgtgccacctacgggcctggggactagtgtgcccagcctgttgcagccactgtcaacaccaatgcagacttcttggaaaccagaggattgtcctgccactgctactgccatttcccatgccatacctgctgtccaggggcctgaagacccagccatccagaccagtggtctaccactgccactgccagcacccaagcaggccagtcacctggaggcccaagattcatcatgcttggactcactaacaccagtgccagcatatactgcactgaagcccaaggacaggcacactcagcctgctgctgccaccagtgaagtccaaggactggccttcttgatgaccccatccccagcaaaacttcactacagcctccactaacaactataccctaagccactgaggaaatcacaaacaccactgatgctgtttacagctgaagaaatcaaacagaaactatactattgcaagcactcaaaatcaaagcaaaagtgccctacccaaacaataccacagatacatcttcaggaaaaattcctcccctataaaagagaattcaaaaaaattagaagaagtggttgttataccagatgcgtggatataaacatgaggacacaagaaacatgcaaaagcaaggaaatatgacactttcaaaggaacacaataattatccaacaacagattccaataaaatgtatgaaatcccatataaagaattcaaaataaggaaattaaagacattcattgagatgcaagataactcagaaaaaaaaagaaatcagaaaaacaattcagagtatcaataagaaatttacaaaacagacagatataataaaaaagaaccaaacataaattctggaactgaagaatctagttattcaacaataactagagaaagcagaagaaagaatttcagaacttgaggacagatttttggaagtaaaccagtcaaacaaaacttttttaaaagaataaaaaagattgacaaaagactacatgacatatggaataccataaagtgactaaatattctaattttcagtgtgccagaaagcaaacagaaaattacaaagagagaaaacctatttaacaaaataatagctgaaaacttcccaagtctggcaagagatttaatatctagataaaaaaatctcagagattcccaaacagatccattcaataaggccttctccatggcacattacagtcaaactgtcaaaagtcaaagacaaagagagaattctaaaatcagcaagagaaaagcacctagttacttataaggaaaccctcatcacactaacagcagatcagatttttcagcaaaaacgtcacaggccaggaaaaaatggaatgatatattcaaagtgttgaaagagaacagctcccagccaaggatgccatacccagcaaatttatccttcataaataaaggacaaatcatctttctaagacaagcaaaagctgagggaattcatcaccactagaccagacctacaagaaatggttaagggagttctacatatggaagcaaaaggacaatatctaccatcatgaagatacataaaagcataaaaccactggttgagtaaacacaaatgaggatcataaaggacccaaatgttaacactacagaaaaacaccaaaccacagtgataaacaataatagaaacaaaaaaaggtatacaaaacaaccagaagtcaattaataaaatgacaggaataagccctcatatatcaataataaccttgagggtaaatgaattaaactttccacttaaaagatataaattgactgacaggattttttaaaaacatgaccaaactatatgctgcctacaagtagctcaactcacccctaaagacatacatggactgaaagtaaaggaatggaaaaatatattccatgcaaatggaaataaaaatgagcaggcatagctatatcaacatcaaataaaacaaagtttaagtcaaaaaacagtaaaaacagacaaaaaaggtcactatatcatgataaaatgatcaaatccacaagagaatataataattctacatatatctgcacccaacttggagaacccagattcatgaagcaaatattaccaaatctaaagacagatagattccaatacaataatagtgggggatttcaacatcttactctcagcattacacagatcatctagacaaaaaattaacaaagaaacactgtatttaagctgtactttagaccaaatgaaactaatacacatttaaaaaatatattatagctacaaaatgcacattcttctcattagcacatagcatattctcaagaatagataatatgttaggcaaaaaaatgactcaacaagtttttaaaaattaaaatcatatcaagtatcttttcagaccacaacggaataaaactagaaatcaataacaagaggaactttgaaacctgcacaagcacatggaaattaaacaacatgctctgaaatgacaattgggtcaagaaagaaattaaggaggtaataaaaaaagtcttgaaacagataaaaattgaagcacaacatattaaaacctatggaatacagcaaaagcagtgctaagagggaagtttatagcaacagatacttacatccaaaaagtagaaagatttcaaataaacaacctaacaatgctcctcaaggaactagaaaaacaagaacaaactcaatccaaaattagaagaagaaaagtgataataatgatcagagcagaactcaatgaaatagagacaaaaaaaacagcaaaggatcaatgaaatgaaaagtttgttttttgaaaacaagattgataaacccctatgtagactaatcaaggagaagacccaaataaacaaaatcagaaagttgtactttagaccaaatgaacctaatacacgtttacaaaatatactaatattttgtatattattatatacaaaatatatatatgagaaatgagaaaggatacattacaactgatactacagaaacacaacagatcaccagagactattatgaacgactatacgctaacaaactgaaaaacatagagaaaataggtaaattcctggacacatacaacctgccaatactgactgacaaaaaaatagaggccaggcgcagtggctcatgtaattccaacactttgggaggccaaggcaggaggattgcttgagaacaggagttggaaaccagcctgggcaacatagcaaggccccgtcaggaaggaaaggaaaagaaaggaaaggagggagagagggaggaaaaaggaaaaggcaaggcaaggcagaaaaggaaaggaaaggaaaaaagaaaggaagaaagaaagaaagagagagagagaaagaaaagaaagaaaggaaggaaggaaggaaggaagaaaagaaaagaaaaagaaaggaaggaaggaaggaaggaaggaagaaaagaaaagaaaaagaaaggaaggaaggaagaaagaaagaaagaaaaaaaagaaagaaagaaagagaaagagagagagagaaaggaaggaaggaaggaaggaaatagtgaacctgaacgactaataataagtagcaagactgaatcagcaataaaatcttccaacagaaaaaaatccaggactggatgccttcactgccaaattttaccaaagttacaacgaagaactaataccaattccacacaaactattccaaaaattgaagaggagataattctctctaactcattctagaggtcagcatcacgctcatatcaaaaccacacagagaggcaacaagaaataaataaaaggaaagaaaagaaaactatagctcattatccctgattagcatggatccaaagatcctcaacaaaatcctagcaaaccaactccaacagtatatcaaaaagataatataccatgagcaagcagaatttatcccagggatgcaaggatcttacatttgtacaaatcaataaacgtgatacatcacatcaacagaatgaaagacagaaaacagatgatcatctcaacagatgcagaaaaagcatttaataaaattcaatatcccttcatgataaaaactatcaacaaattagtcatagaaggagcatacctcaacataataaaagccatatataaaaacccagagctaacatcacaccaaatgaggaggagctgaaagtctttcctctaagaactagaatgggaaaaagatgcccacgttcaccactcctatccaataaaatgctggaagtcctatccagggcaataaagcaagagaaaaacataaaaggtaccaaattggaaaagaggaagtaaaattattcctctttgcagatgacatgctcttacatctgcaaaaacttggaagattcataaaaaaattctaggtccgataaataaattcagcaaatttgtaggacacaaagtcaacatacaaaaattagtagtgtttctacacatcaatgatgaactagctgagaaagaaatcaagaaggcaatcccatttacaatagctacaaaaaataaaatacctaggaataaatgtaaccaaaaaggtgaaagacctctacaaggaaaactataaacgtctgatgaaataaattgaagaggtcacacaaacaaatcgaaaaacatcccatgctcatgggttggaagaattaatatcattaaaatgaccaccatactacccaaagcaatctacagagtcaatgcaatcactatcaaaataccaaagtcactttgtacagaaatagaaaaaaaatcctacagttcatatggaaccaaaaaagagctcaaacaaccaaagcaatcctgagtcaaaagaaggcatcacactacctgaaaacagacacataaaccaaaggaacagagtgtaaaccccagaaataaaccaacttattaataactaactgatttttcacaaaggcatcttggtcagagaacatgcattggagaaagaataccctcttcaatcctcttcaataaatggtgcggggaaaattggatatccataagcagaaaaatgaaactggactcttatctctcaccataaataaaaataaactcaagatggattaaagacttaaacataagacctgaaacgataaaactactagaagaaaacatacgagaagcatttcaagacatcgatctagacaaagatttttatagctaagacctcaaaagcaaagataacaaacataaacatagacaaatagtactatattaaactaaaaagcttcttcacagcaaaggaagcattcaacagaatgtagagacaacttgttgaatgggagaaaatatttgcagactattcatttgacaaggtactaatatctggaatacacaaggaactcaactgaacagtaaaaaagcaaataaccccatttaaaagtgggcaaaggacatgaatagacatttctctaaagaagacatacaaatggccaacaggtatatgcacaaatggtcaacatcactaatcatcagggaactgtaaatcaaaaccacaaatactatcttactccagttagaatgactattactgaaaagacaaaaaataatagatgctggagaggatgcagagaagaggaaacatttatacacggttgtgggaatatgagtgagtacagccacaatggaaatactatatttctcaagaaactaatagtagagtcattaccatacaatccaagaatcccactaataggtaactatccacagaaaaagaaatcagtataacaaaaagatacttgcaccccatgtttactgcagcactattcacaatagcaaagatatagaatcaacctaagtgtccatcaacagatgaatggctaaaaaagaataaaatcatgtcttccacagcaacatggatggaactggaggtcattatgttaagtgaaattagatagagaaagacaaattttgcatcttgccactcacatgtcagaggtaaaaatgttgatctcatggaggtagagagtgaaataatagagacgagaggctaggaggggtatatgagtggcagagaggaatgaagaaaggctgatgaatgggtacaagcatgcatttaaatagaaggaataagttctaatgtttgacagcataatagtgtgactatacttaacaacatgtatggtatatttcaaaatagctagaagagaggacttgaaatattcccaacatagagaaatgataaatactagaggtgatagatacccgaattaccttgacttgatcattacacattctatgcatgtaacaaaataccacacataccccataaatatgtacaaatattacgtgtcaatttaaaaaatgtatttaaccttcaccaatgtagttgagaggaggaactgtttacactgaatctaaattgaattttaagcatcatttaaattaattcatataaaattcactcagtcactagtgactaataaagtgaactctaataactcaggaagaaatgtttagtttcatattcaaattgtaaattaaaccagagcagtattattcaaatttttttcaggcatcagggtacccagagcttataatgcattttgcagaccacccaaaatactgattaagcttcaaaataaataaataactttttgctaaatcggaccactttttttttttttttttaacagcatctcgctccatcacccaggctggagtgcagtggtacaatcacaactcacagcagctctacctcctgagctcaagcgatcctgccacctcagcctctcgagtagctgggactacaggtgaacgccaccaggcctggctaatttttgtattttttgtattttttgtcagagataggattttgccatgttgtccaggtcggtctctaactcttaggctcagggaatccacccactttggcctcccaaagtgctggaattacaggcatgagccactgcgctcagctcagaccacttctcacaccagattctgttatttatacctgagaaaacgtatgggtggtagcatgggatgaagggagattaaaccattatttgattttagtagcgaaaatctttagttggattacacctcagaagaatagtttgggaagcactaaactagagaattataagcacagccacatttacatgtgcaatttaaattagatcttttaatgcctttttaaagtttaaaaatatcaacagcaccaaataacctcctcaaatctaagcatctatcatttgctttcatcttctgccttcagaaaatacagatttggctcaattgaatagcaagctaaggtcaccagggctctcaagataacagaactcttgaactgacacaccacattctttcttactgatttcatctagttaggcctccgtgtgattacactgagcattgcacgctctcatttaagatctcacttgcctccatcttcatccttcatttccctaacttctcaaatcctcactgatctttgattttctggctcttatcttggaaggttatttgttttgtttggtaattgtttgtatctcccctccccacacatgaagggatcagtgtacctactctatttcttttatcaaataaacacagcgctgagcaaagaaagcaacaaatatttaaccagcttttaacttatccactgacatctgtgagatttctgaggttctatttcaatgctccttgatattgaatagttgcttcaacttaaaaagtactatttttcaccttagaaatatttcttttggccaggcgcagtggcttacgcctgtaatcccagcactttgggaggctgaggcgggcagatcacctgaggtcaggagttcgagactggccaatatggagaaaccccatctctactaaaaatacaaaattagctgggcgtggtggcacatgcctgtaatcacagctactcaggaggctgaggcaggagaatcgcttgaacccgggaggcagaggctgcagtgagccaagattgtgccactgcactccaggctgggcaacaagagtgaaactccatctcaaaaaaaaaaaaaaaaaaagaaaagaaaagaaatctttcttttgccctgtttaccttccagtttatttttaactcttcacaaggctgttgtgtcagggcccttgtgtcagggccctcagagtagtgctccgggttatgaagaaaatgtacagagacagaaagccagtctaacggtgtgagcaaagcaagaatttgacactaaaagtgactacagaggcagcaaaaaggagcacagccagcaggcccagttctttcaagaaagaatacttatctcaggaaaacttggcgctgctcttccattttattttttcctttttctgtaaaatatgctaaaagatacctacctacatatctgctttatattgtcaattttcatgtaaaatcagtttgtacctattttttacttttataaattgattgtaccacaaagtttttaaaaattctaaatctctgaaaaacatacctctgtatttcaattataaacccaatttttataacaagaagactcaaaaagaaaaaaaaatcacatctttcagcttaccatatattggggaaaatgtgaagtagttcaggtgacaaatattataggcttcaattctaacatctttccagattccctgggtaggaaaggaaggcccccagtcccaactaaaggaacattgctcctgcaatttcaaggagaaaaagaagatatattctgattatggtgaaatttaaacattatgaaaaacattttctttaaaaatgttacatatgtgtatataagtttgctatggcagccataacaaagtatcacaaactaagtggtttaaacaatggaaatgtattttctcacagtgaagtccaagatcaagctatcagcaggtttggttcctcctgaagccgatctcctctgtttgcactgtgtcctcacatggtctttttctgtgctaggcatccctggtgtctctctccattgtccaaatgtccccttcttaaaaggacactagttgtattggaatagggcccacactaactgcctcattttatcttaatcaccccttaaagaccttctccaaatatgattacattctgagataccagaggttaggacttcaacatatgaatttggggggaccacaagttagtgcaaaactgtgtgtgccccccaaccaccatacacagcctctgaggtggcccacaatgatcccccctttgaagtgacctagtgaatcacttctaaccaccagcatatagcaaaaatgatgtgattttattaattaggttataagagactaagccttgaattttgggtactctctcatgccctctcttggccaagagggaagccagcctctgtgtcatggggcagctctgcggagagacccatatgggcaatctgaggtctgccaataactacaagtgagctcagaaacagactcttcagccttgagtcaacttgagccaagccttgagacaactgcagccatgagaccttaagccagaggcacccagctgagccacactcaactcagattcctaactaacagaagctatcataataaatgttttgtttatattattttttagaaatcagaaaacctatagtccacatattttctttttttaacttttaagttcaggggtacaagtgcaggtttgttatataggtaaacttgtgtcatgggggtttgtcatagagattatttcatcatccagctattaagcctagtacccattagttatttttcctgatcttctctctcctcccaccctccaccttctggcaggccccagggtgtgttgttcccctctatgtgtccatgtgttctcatcaataaatgttgttttaagctgataagttttggcataatttgttacatcacaatagataactgatacaatatccaatatatccaatatatctatgttgcacgtaacctatgaaacagataaatttggcagaaatgttctaagaacataaaatctatgaagagttgtacatttattcttcaaatgcttactacattgaagcaactcaatagttcctctttaaatttctctataatatctctgaacctaaccattgtatttaaatctaatagttacaaagaatattgtgcttacatgtaataattaaaaagaatgaggaggccgggcgcagtggctcacgcatgtaatatcaacactttgggaggccgaggcgggtggatcatctgaggttgggagttcaaggccagcctgaccaacatggagaaaccccgtctctactaaaaatacaaaattagttgggtgtggtggtatatgcctgtaatcccagctactcaagaggctcaggcaggagaatcgcttgaacccgggaggcggaggttatagtgagttgagatcgcaccactgcactccagcctgggcaacaagagtgaaactcagtctcaaaaaaaaaaaaaaaaaaaaaaaaagaatgaggaaacatattgaaagacaaacacttataaataggttttaaaaagctctggctaaacttgccaacctcaggtatgaattcagaagtccttgtttctgaacgtgaagcccaaaagcaatcagttcgatctttagcccctgaaacaggtggccaaggcagacattttatccaatcttatttgacctgggtacctgtctctcccttgatgacactcaacttccatattaagttacagagttcaaattcaaaaataagaaataattctgtaaaataaatccctttcacacagaatgttttctaatttctacttcttaaaagaaaaaaatattttcagaacagttaattaaaatgtgtaaagctataagttcagcttttaaaaaggaataagtttgggtcatacattttatggggggaaaaaaagtaacaagcaccagaggaaatactaaaatccttctagatggagtcatttgtgaaatagaacctgaagatttggccaaactgttgtcatttgggtattatttccttagctctgtactcacctaagatagagacaaatttgtttttactatggagaaaaacaaagaactaaagttactttatagcatccacatctgtctaaatttaccacttaagcaccagattctcatattcagaatgaaaaccatcttggggacatttatgggagaattttagtatctatttgtaattttttcattggagatagggaaaagaaggagagcaaaataatcaacatcttatgagggagactattttccccattaagagctacaaatcactcttaacctcttcaagaagtatttattaagtgccttctatgtttcaggctgggagtacttcaatatacacaacagacacagctcttctgcttataatgctcacagtcaagcacgaaattcaagcattgaataaataattacaagtataatgagttttacaatggaaataggcagggaacatacagtgagaggttgaggaggatgggtatcaagatgagttttcctgaaaaaaaaaaaaaagaccctgaagggtgagtaccgtttatccactgtgagcaggcaggaactttttttttttttttttgagatgtctcactctgtcacccaggctggagtatagtgacacaatcttggctcactgcagcctcaacctccaggctcctcccacctcagcctcctgagtggcagggactacaggctaatttttgtatttttttttagacttggggttttgtcatgttgtccaagctgatcttaagctcctgaactcaagtgatccacctgccttggcctgccaaagtgctgggattacagtcatgagtcactgtgccggcccagaagcattcctttcagaaggaacagcatgtgcaaaggtctggaggtgcaggacagtctgatgcattccagaagctgaagagagaacaatgggaagaggcagggagatgactggagaagtgagcatgggccagacagagctaagacccatggacactggcctaaaggcaatgagaagctgttgaagagtttgaagaaaagcagtgctgtgatcatttttttctgaaaagaccattctagctgctctgtaaatgattaactagaggaaggcaagtgaagtttcagggatgccagttaggcaaccagggcaatatttcatgcaaggcatgactgaactcaagacacagtggcagaaatgaaatgtgaacagactgaagagctattgaagaggtactattcacatcatcaagaggactaagcaatagattggaagagagaaaaaggagagaaaggtgtcaagaaaaactcaagtttctggcttgagcacctgttgtggatagtattccattcagcaagagacagaaccctgggagaaggacttaaatcacaagtgcggtgtggcgcatactgagctttaggtccctgtgaatcagacaagtgatgatgctaaataagcatctgaatgtaaggtctggaattgaagacaagttggacggaagacacaatattgggagacaatggcaaatagatttgttatggaagaaatgaaaaatgagatagcctagagagggtataaaatgagaaaagagtctagaacagagaaaggccctataatataacttttaggagaacaaggatgtggataaagagacttacaaggaacggccagagatgtaaacggaaaacaaggaagatggcatcaaacactggtaagagggtagcagaagtgatgagtcccactatccattctggacagaaaaggaagcagagacaataggggacttaggttgctacagggaaagtggaggttcaaagaactggtgaaagagaatatcaggggaaccagcccccaatatttcaacataggttcttttctattttccctaagtgtcagccagtctgagaaataaacagaaagagtacaaagagagaaattttacagctgggcctctggggatgacatcacatattggtaggaccgtgatgacgaccccaagccacaaaaccagcaagtttttattagggattttaacaggggagggggtgtacaaacagggagtaagtcacaaagatcacatgcttcaaagggcaataaagatcacaaggcaaggcaaaattagaattactgatgacggtctatgtcccgctgtgcaaacattgtcttgataagcatcttaacaggaaacagggttcgagagcagagaatcagtctgactagaatttaccaggctggaatttcccaatcctagtaagcctgagggtactgcaggagaccagggtgtatttcagtccttatctcaaccgcataagacagacactcccagggtggccgtctacagacctacccccaggaatgcattccttccccagggttactccttgctgggaaaagaattcagcgatatttctcctacttgcacatccgtttataggctttctgcaagaagataaatatggctctattctgcctgaccccacaggcagtcagatgttatggttatcttcccttcttccctgaaaatcgccgttattctgttctttttcagggtgcactgatcatattgttcaaacacacattttacaatcagatttcatattgttcaaacacacatgttctacaatcaatttgtacaatagtggtcctgaggtgatgtacagtctcagtttatgaagataacaggattaagagattaaagtaaagaccccactaacttcatataacctaagctgagcatcttgttcattacccgtaattatagtaataagcctccaaaatagatatcaccactctactttttgaatggttgtatagcactttacaacatgcaaagtgcatttacattgttatttcactatatcttcatatcagggattagctccatgtacaaatgacgggcatacctcaagttattctatgttcacaaagccagaattcagacccaagactcttcacttggtctccaactcaggtgtcttcccactggaccatgtcaatctagtcagaaatacctagatgcaacttgcaattgttctggaagcctacccagaggttagtgtccaaaacattgtgatagcagaaaactggatctgattcctgatgttagtgacaaagggctatgttctatctagataacttgagagtatgttttaaatgccacaaattgaatagagggtggagcaaaatagcatatggatatatgtataacatttatattatctttattgatgacttgaaaagtaacttttcacattaggatccaggatagtttcagttttgataaaggttaaaaatggaaggggaagccagcacagtagctcacgcctgtaatcccagcactttgggaggccaaggtgggtggatcacctgaggtcaggagttcatgagcagcctggccaacatggtgaaaccccatctctactaaaactacaaaaattagccgggcatggtggcaggcgcctgtagtcctagctacttgggaggctgaggcaaaagaatggcgtgaacccaggaggcggagcttgcagtgagctgagattgtgccactgcactccagcctgggcaacagagcaagactcagtctcaaaaaaaaaaaaatacaaaaattagccgggcatggtggcaggcgcctgtaatcccagctactcgggaggctgaggcaggagaatcacttgaacccgggaggcagaggttgcagtgagccgaggtcatgccactgcactccagcctgggcaacagagtcagacttcatctcaaaaaaaaaaaaggaaggggagagggaaaaagtacaacctctagcatttaaaccactgtgtcattggaagccaaaggcaaaagaatcaaaagataaatcttatccagacttataagcagacaaatattccatggaatacttgactactgaaaattgtcaaagcaatactctaaggctgttattacagtaatttgaacaaatggtcaatgggtcattgacacaagtttaggtaggttgaatcaaacaggaggaggtataattttaatcctagtacttatattaaggaaacataatttaatagtaaatcaatccagctgaaaaagagccatttaatttaatcagaacatattagctaatgtaacagttctacctaaagagtattgggaaaatatgtttagtatcttcacaatgagcccaatcattacatttgttgttaaaactaaatttcatggctcacgcctgtaatcccaacactttgggaggccgaggcgggtggatcacctgaggtcaggagttcaagagcagcctggccaacatggcgaaactccgtctctactaaaaattaaaaaattagccaagtgtggcagtgcatgcgtggaatcccagctactcagggggctgaggcaagagaattgttttaacacgggaggcggaggttgcagtgagccgagatctcgctactgcactctagcttgagcaacagagcaagactccatctcaaatacataaataaataaataaataaataaataaattcaatccatcaaaaaattaaaaatagaattaccatatgatccaaccatactatttctgggaatatatccaaaagaactgaaagaagggtcatgtaaagatatttgtacacccatgttcatagcagcattattcacaatagtcaaaaggtggaagcaacctaaacgtccgtcaacagatgaatggataaacaaaatgtggtatatgcatagaatggtatgttattcagccttaaaatgtaaagaaattctctcacatgctacaacatggatgaatcatgaggaaattatgctaagtgaaataagtcagtcacaaaaagacaaatactgtatgattccacttatataacatttctaggggaatcaaacacatagaaaagagtagaatgggccaagcatggtggctcacacctgtaatcccggcactttgggaggccaaagtgggcagattgcttgagccttagagttagagaccagcctgggcaacatggcaaaatcctgtctctacaaaaaaaatacaaaaattatctgggcatggtggtgttcgcctgtagtcctagctactcaagagacctaggtgggagcatcgcttgagcccagaaggtggaggctgcagtgagttgtgatcgcaccactgtactccagcctgggcgacagagtgtgacccagtctcaaaaaaaaaaaaaaaaaaagagaaagaaaagaaaagagtagaatgctggttgcaaggggctggggagaaggaaatggagagctattgtttaaacaataatgggtataatataatataatgggtaatgggtagagtttcagttttgcaaggtgagaaagctctgtggttacttaatgtaaatatacttaacactactaaactgtacacttaaaaattattaaagtgataaattttatgtacagtttatacaattaaaatttttaaaatatgaagtaaaatgaaataaacattaaaaaaccaaatgtcacatagaatactgattcaatcatgtagtaaaatagatccaagtcctcttagactggaatcatactctaagaaaaataattacttttgtggactttgttatctttttgttagattttatgagaacctgacagtaagatgcaagaacatatcatcaaatatactaatatttgcagagggcttcctagaaacaagaatcactaatacattttcacaatctggtgaaaagtttgataaacttaaatgttaaaaaaataatttgtaaagttccattatcagccacatatttttcctttctttttctgttacctaagttctgaacacgcttcaggaagaaaacttagaaaaagataaagattctccacaatatttcaaataatcttttggttcttatttcaaattttcaaaccccactaagggatcaggaaagagattcctaacttctgaaatgccatgggagtcttcaaataagcatttcatatgccagcacaccccgtcctcaaaaataaaacccgacctgtttgagagaccattaccttccgaacaaagttgacatggcattcacccttctgcacaagtggagggcagtctgggggaacctggtagcgagtgtgagctttgctctgctgtgctgcatacaacaccgctgactggaaacgcagctcaatggagttcacgtccctgaccacgttggtaatatcaaagctctaagttaaagggaacaatcagacaaacccatgatgtggaagtagtcttgtgtgtaaaattttagataaaggcattttgtatgaaagacacataatataatgccgatctaggtttagcctccttgcaggagggaacacttctctgaaacactgtagtatctatcacttagttgcccacttttagttaaaactaagcatattttcctacccaatccaagtttctaggcttctccttctatttttcctggcaaaatgatggtcctagggaaatggatagagcaaaaaataactttagctctggaatgtctgctctgtctacttatatgtggccttgaactgccaagggtttcctagacacttcatgacaacctgcctctccggtatgaacagcatgcatttctaagtaatgagttatttttgttttgaaaagtctacctttgaaaggaaaggaagatcagcatataatctcttaatataactattccagaaaggaaatgacattttattttaaaatcatttgtccaatgaaactgtatcagcagaggagggattggcatgttttgaacacttcctatgtgccaagaacttgccaacattttatacaattagcttactaaatccccacactaaccccatggggtttgtaaggtttccattattccacaaatgtggcaactgagaaatcaagtaactcatccagtgctttaatgagctcatatttgtcacatggccaattatgcatttacttttctctactcacaaaagcaattaacataaacacacataaattttttttaacctaatgtcattatatacttacatatctattgaacatattgtctgtttccccaatagtgacttcattgaacaggatttttgaaaccgtatccactccctcaagaatcaaatttactttttgccatttgctaaaaaaaagaaaagatttttaaaacaagatgtgtaaagcattaacttagataagtctcttttttattatttaaggcctaaagaaataaatattccacaaaaaatatatgttcttaaaaggcagtttccagtgacattttcagaagtactgctttaaaacatacttacgtcctttgagtgatccagcttatctttctctataatgtatcaataaatcaccataaaaccaagagcacaacttataatttccaaatatattgactttttctagttaatacttcagaaagctattatgagaaccaagttaggccaggagcagtggctcacgcctgtaatcccagcactttgggaagcctaggcaggcagatcacctgaggtcaggagttcgagaccatcctggccaacatggcgaaaccctgtctctactaaaattacaaaaaactagccaggcgtggtggcgggtgcctgtaatccaagctactagggaggctgaggcaggagaaacacttgaacccaggaggcggaggttgcagtgagtggatatcccaccactgcacttgcaagattccgtctcaaaaaaaaaaaaaaaatgagaaccaagttaaataatagacataaaatgttctcacaaactacatttactgaccctgtctaagagaacacgttagaaaactatcatctataagtgaatattatgcacccagcactctgctaagccttacaggaaactataacagtgcctgtacttaaggagtctgcaatctggttggcatttggtggctggctggcaatattgttgaacaactacaagtgctatcagagtttatctcataagaaaagatttcaaaatggaaacaagaacttaatgaagagaagaataaataaaatgtgttgtattcatacaataaaatactattcaacaataaaaaggaatgaagtactgatacatgctacaacatggatgaactttgaaaacattattatgctaagtgaaagaggcggtcacaaaggcccacatattgtatgattccatttatatgaggtatccagaacaaggaaatccagagggacagaaagtaaattagtggttcctagggctggggtaagaattcaggggcaggaggagtgggcaatgggaaatgactgctaatgggtgtaactttttgtggggggatgaggaaaatgttctaaaattgattgtggtgatggttttgtaactgtaagtatactaaaaaccattgaattatataccttaaatgactgaattgtacaatatgttaattatatatcaataaagtattttttttaaaactaggtagaaatgactgggtggaggcatttctactccccttataccctttgctctttgcaggaaccccttacccctgcaaagagcaaaaccaaaacaaggaagtgctgacagcatgaattacttttaggtaatcgactcatatgtgtaatttgggctggggagctaaggaggaaaaagctggacaaatccaaggggcagagaggtgcgggcagtgttacagggacagacatctttcagctgtattttcacagacaagtgagaagtttatacttgatttgccaagtaaaatagacacttgctattcttgaacgaatacctatcttggcacaatcaatattctgtgatgattaatctaatgtttctaaattgaaaagattggagaataaaagaacaaagcaagaaatttgattaggcagctttggcctctttcctggcactcttctaggcaaagatggaaagatggaaatgagatggaaggggccaaaccaagagaaatgttaaacaaaaatttgcaagacccacccagaacagactgaacacaggaagatgaagaaaagatgtaataagcccaaagcaccttagacatagactggaaaatggtgttacattaagaaaaacaatgaagctgttagaatataaagttagttttaagggggaaaatcaattggatatgttgagttcaaggtgaaatagaaccattacgaaagatattctaaatattatctgtaaataaaagcctggagcacagcagtaactccatgatattgataacaatattctggccttttcccccctttaaaagactagtaaataattaccaaaaaaaaaaatcacataaaagggacagaaggattttttttttcatttagcagtagtggtggtacctttgggtaacgttctacctcatatggaaatatttgcttataataacagaacattactgaaaacagtatctgtgcttcacctcctggcttcaccacatagtataggtcaaggtcatagtctcaatggctggttagcactacatagggcataaccactggaaaaatgactccataagacacaatttggtgactgttgattagtagcaccatcctcatatacaaaacaaaacataaataatatattcacttttatagtacaaggctttcatcttacttaactctcagatatgtaacctaaacaaacaaaacaaaacaaaacatacaaaacaaaaaaaaaacaaacaaaacacaacatttttgcccagatagaaaaagaagaaaagttcaaataataataaaaatacacccacaaacatacatacctaatttcaaaggggattttaaattctttgctataggtccagttatccaaagagacccatctgtagttaaggtcattaaatctgtagtaagaatcctgttgatacaaggtaaaaattatggtagatggttaaatatgcacaaataaattaataaaacaaacataaaataaattattaacaacagctatttatcacctaaaaattaacgaacttttagcctagtagtacaaagaggggacagatcgttaatactgaaaaatgtgaagggaaaattccaacaaattacctgaaatgaaataatcctctgagatataaataatacagcttcattatcaaagaaaattggtgggcattaagattggcttccccttggagacagggtttcaccatgttggccaagctggtctcaaactcctgacctcaagtgatccacctacctcagcctcccaaagtgctaggattacaggcatgagccatcatgtccggcctacagtttatcttgtgtactaacctgtttcactctctaaatgagcaaagtgggagatcactgtcacggctgaagttacatggccaagacaaactatggtctgggagtcccaggttctcctgtgtgggcactttcctggaagatgctaaatgataggaaaatctgggtttcatgtttctgtgtggtcctcacctcacttgacttctgctctttctgtttgctctgggcttccgtgctctcattgatatagttctcagttttccattggtctgtatcccattctgccttggacatctttacttcttgctgctcactgatgaatcaggaggcctgtcctggagatgagcttggtataggccaattgcacatgggtctcagagcactccatcttcaaggtccagataacatgagaaatgagtcttctcacatcattattggggatgaggggccgtagctgctggtttagctgaatttcaaactgatcacctggggacgagagcaatgggtaattgaagcttttgggctcgggagacaggccagtgcccatgttgttgtattcccattgtgtttcacagtcttctctaagttgaacgcagtctcagcagaatctccctcaggaggatggttgtaggttgtgttttcagagatggtgccttctggcatagtagtgttttccataaaaatgttttgttcaaaggcatttcttgcagtggtgcttttaaaacattctgatggagaaatacttccggaaaaggattttcctgaagactcaggtctcctaaagatgaaaaagccccttgtgaaggggcatttatgaggcttttcactgcagagaatggaggcctctttgcaagcaaagtctactgagagaacttttctggaatgtacgattggttttaactcaactttgcattttctaaaaccaaaatgggtaagtctttcaatctgtttctgaccacaggtagggcttttgcaggggtggagatagaaggcacgcccatggagaagggtttcagcaaagagaagactgctgccttatgctcttggttgaacgaaggcttggtatagatggcgtttcctgctaacttctcatgcccctgctctatgtgaggctgttccagctcccttggggctggactcctgagccttttttctttggcagcattctccacaaatgcccaggcaccctgttccttcctgttgctctgctttcccacctctttgaagtgacttttctggatgctccttgggcccatgaggattctgttcactctctgcaggcttttgcctacactttgaatcttagccaggctgttttcctgtggttggacagtttctaatttcatgagtttttggatgcagattgaagagagggactctttgtatggtttttcggaatacccatctttcacatttgaaaaaaacaggtaactataaggttagctgttggcagagctagcagaggttttattttggaccaaaaaaaaaaagcaattgaattgttttgtagctgaaggcataggcatggggggtccccaggtagtaaactaccctgtgggtgggttgagggctagggctgggcctcaggtgggtctcacgttccctgtgctcccttctgctctctgggagagtcgcaggaggggcaggctgggaggggctgccgcagctgttcacttgggcaggacgtcagaggactaggacaccagcctcccatcatgggtctcgatcttcttcacaaccactgccctggtggtgctggtgcggctgaaggagctggagcccacaccagagccaaagctggggcttgggaggcccccacaggccgagctcagatcacctgcataaccactggtggtctttgtatggatactcatgttctgcatcccagagtccagctggctctcctcgccctccagcagcttcctgtaggtggctatctcgatgtccagggccagcttgatgttcatcagttcctggtactcaagcagttgccatgccatgtcctgcttggcctgctgcagggcggcctccagcttggacagcttggcgttggcatccttaacagccagccccctgtgctgcagacatctgtgatggtgccctccagggaagccctctggcctttgaggccctcagtctcagcctggagctggctgatgttccggttcatctcagaaatctcagtctttgtacactgcaggtcatcctcgtgcttcccagccagcatctgcagctcctcatccttgatctggtacatgctctcagccttggcctggctgcagttggcgatctcctcgtatggtgccttgacctcagcgatgatgctgttcatgcccagggagcggctgttgtccatgggcagcaccacagatgtgtccgagatctgggactgcagctcctggatctcctcttcatacagctgcttgaggaaattgatctcgtcagtcagcccttccaggtgagactccagctctaccttgttcatgtaaccttcatccacatcctcttgatgaggacaaattcattctccacctctgtacacttattgatctcatcctcatacttgttcttgaagtcctccaccagcccgggcatgttgccaagctccgcctccagcttcagcttctcctggcccagagtcttcagctgctgcctaaggttgttgatgtagctctggaacatgttgtccatgttgctctgagccatcttctgctgctgcaggaggctccacttagtctccagcatcttgttctactgctccaggaaccataccttgtctatgaaggaggcaaacttgttgttgagggtcttgatctgctgcttctcctgggtgcgcacagcctggatgttggggtccacctccaggttaagggggctcagcaggctctggttgactgtgatggtggtgatgccacccacgctgctgccctcaccatagcctccgcccagacaaccttggaagctgctgctgcccactagggagaagcctgaggagcttatctggacactgggcccacttgtgtaggagtggctgctgaaggcccggggcccagaggtggacaccttgtaggacttctgggtcaccctgatggacatggtggaggcaggagtgggggcaggaaggccgaaccagatagagatcccagaaggagtggagaagctgcttcttggtcttttcagttaactttaccacatatcgtctcatgaccggaggaatttacaagagggtataacttagatttatccacatttctcatgaccttccctgtgccacctggagggctgtaagcagggtttgcttagtgtagcaagtcggcaaccttgctgtggcacctagataagggttcaggaatgcagctgcagagtattcggggtaagggtcagctgcactgcgggggcggttcctggggcagctcgtccctaacagtaacaacattgattctacatcttatagatttttctatgagaaataaggcaagacgtaatttagtgcgtcattgatgtctagctgctcactcccaaagcctgacaagttgatgccattgctgtctgaggccgcctccagctcagtagtcagctcagtgctcgtgtgcttcttccgggcttgtaataccttcatgaacgctccttctggattccctacagatagatgcttcttcaactgtcaggtaagacacaataagtctttctgagtttctcttatagggtttagcttgttaatttccttatcctttgtcctcaaactcaactatcttgttcttccttgcgcctagttaccataaacagcctacccgcttcccgtcagctctaatcaataactcacatctgttcccttggttacctgcaccccatgttcccctgaaactgcacatctcacacgctccacctctgtccccctccccttctatatttaaaaaaatatgtacaagtagccaattgggtcagctcaaactgtgcagtccaaccccagcccaagggggagtagcacagagatagggactgcgttgaggataaaaaccccctggtctcctttgttctctgtgctcttgcgatcttgattgacgcaagtggcacccttctgcagaagtaaattgccttgctgaaagaattaaaaaaaaaaaaaagattggcttccccttttaaaaccaaacacaaaaccaccagtatcagcagagaatgaaagactgaatctgtggtgtgtagccagcagtctctcattgccctgtggttctcactgtgctgtttgcgccactatcccagccagcctccagggggaatacttctctactgcccaaaagtcagcacaactcccttccgctcattggattcacttagcatttccagttatttttcacttagctaagtgagcatgaaaaggatctctacagagaatacacaggcagcagagatacttcaaaacttattaacatcaggtttcttatattatcctacctcaggtcagcaaactgccacccacaggccacattcagctcactacatgtctctgtgtggctagcaagctaagtaagaatggacatgtgcccataaataaagttttactagagcacagccatgccctttcctttgcaatttacatatggctgctttggtgctatagtggcagagttgagtagacatgatggagaccatctggccctcgaggtctaaaatatttagtatttagctatttactgaacgtgtttgctaacccctgcccaagatgactggcctcctagatgttcatagatgttgctccatctgagtgtctagacccaagtctgcctcttcataaatccttaagtctttcttctcctaccccctttccactctttttacacttttttttttgagatggagtttcactcttgttgcccaggctggagtgtaatggcgcaatcccagctcactgcaacttcagcctcccaggttcaagcgattctcctgcctcagcttcccaagtagctgggattacaggcatgcaccaccacacctggctaattttttgtgtgtttttagtagacatgggttttcaccatgttggtcaggctggtctcgaactcctgacctcaggtgatctgcctgtctcagcctcccaaagtgctgggattacagacatgagccaccgcatctggactctttccactctttatctcccagaggaatactcaagacaggaggcagaacagaaagtggcaaacaaatcttttcagttcatctatccatgaacaatatatagaagggaattgtgcaggcatggaggggcttcccctcctttgtcagggacagatccaagttatttccttagggaccgtaactccaagtcaagaaggaaaagccaactctgtctaagttccacacaggtaagagccagatgaacacgttaggctggcaatggccagttaggcagttgcccagggcaaatctgtaagaagcactacaacatcagtgggagtgtatcaagatcaagataggtatctgccagaaactgatccaaactggaagaaatattttgataagctactagaggagagagtgactgatgagatttaaaacaacacgtaatcaccaaactggcttttaaggtctggttaatggtaaggttttgttctgttaaatgccgtgtgccaagcccagccaacttatctcccacacaggactcggcctctccaatgaacaaacatggaacacatatttacagacacagggttgaagaggcacctaattattagcatgaccatgtcactcccccaagacctatttataactctacactgtggacttagtccaatacagttaaaaatatcatgagaaggaaggtgtgagagcaattcagccacaacacatcaacacactaagcccgggggctggctgatgatctggttgacggggcacaagtccccttcctttctcccagctccctgaaggaatctgcaagttggttcaagagggcaatcttcccagatatattttttcgacacaaacataatttataggttaaaattttatcttaaagaggccaatctgaaaaacctaaataatgtatgatttcaactatatgtcattctggatgttaaataaaaattacaggaggccgttgttgactgagctcctatactaggcctcagcagaccagatcaaaccaaaacagtcactcatgctaagtaccacttaatcaaactgaaactttaacgaaggaggtagatccgcaaacagggcagtttttcctgaaaacttgagattcctgttcacctgagtaaggaagtcctctctgcattttttttttttttttttgaaacaggtcttgctctgctctgtcacccaggctggagtgcagtggcacaaccatggttcactacagcctcaacctccggggctcaagcaaccctcccagctcagcctcctgaggagctggggctacagatgtatgccaccactcccagctaattttttatttttatttttttgtagagatggagatcttactatgttgccaaggctggtctcaaaatccttagctctagcaatcctcctaccttggcctcccaaaatgctgagattacaggcgtaagccaccacactggccggttctctctgcttttaccctttctagaaaagtaacctgaagtaatctgatgttaatcaatcagtttttttcctactgttctgtttctttgttccttacaaaacccactattcttccatggccccatgaaagtgctcactgtattttgtagaatggatgctttcctgattcatgaatcacaaataaaaaacaatttgatctttaactacatttgttgtaattttgtcttttgacatggaaaagaaaaaactatggagacagtgaaaggatcagtggttaccataggttaagcagaggagaagaatgaataaacagagcacagagaatgtttatggcacggaaattattctttacaatattgcaatggtgaatacaagtcattatacatttgtccaaacccacagcatgtacaaccaagaatgaaccctaatgtaaagtgtggactttgactgataaagatgtgtcaatgtctgttcattgattctaacaaatgtaccactctggtggggaatgttgaagaatgggatgctgtgcatgcaaggaggtaggaggttatgtgagaaccctctgtactttctgttcaattttgctgtaaacctacaaagtctactcttccgggggagaagggcagcagcgtgagagttggctctgaagagtggtgagtcagaagagacctcaggcagcaagcgacttgggccatggcctctgacctagacttctcacctctggaggtgcctgagcccactttcctggagaacctgctatggtacggactcttcctgggagccatcttccagctcatctgtgtgctggccatcatcatacccattcccaagttccacgaggtggaggctgaaccatctgagctcagaagtgctgaggtgacgaggaagcccaaggctactgttccttctgtgaacaagaggcccaagaaagagaccaagaagaagcggtagaagaggaggcccgaggagccagacaggcagggagagggccttggggacagccctcctgggaatctatatcctgttccccctctccatcccaggttcagggtctgaggaggctgtgacaccctctgacctcagagatctagacagtcatgacagtccccaggctccagctgtgcagtccaccacttcctcttccttctgcttctgtgatggtttagagtcaaggggactgaaacacactgtgactgtattaggaggtttgtttagaagttgggtcagctcacagagtcacattttcttacttagtcatgtgtccagccttgagtcaccccctccttgtgagtttacattacattttggagtcattatctaatgctgacaagcccaccctctcccattatttgtgcactacagatctcctgctaatcagtcaccttttttgctgctgtgtagacagagccaggcctcacctgtttgtttaggccaaaacgccatggccatgcaatgttagtgatcccactagctgcgacagccaggcccagaaaatgcctgacatgagagccagcagacagcccaggccagggtaggcagtgcctgcttctgctctgtcaggtgcaagggatttggctgaaggcatgcatatttcctggacacaaacttcctgagcttctgaaatgggaggctcatcaatttcagaccaacctcttttcaacccttcaacccatcatagcacgttcaaggtgtgccttttacttccacctgtacatcccccattccttcaattctttcattccctaaccagagagagttcctgggggaaatgtggcgaataaactgcatgcatgctgaaaaaaaaaaaaaagaaagaaaagtctactaaaaatttttctcttactaagagaaaataccaaaaaaaaaaaaaaaagttatagaggcttaaattacatttaaaataactattccaaaggccaatcaaccaacctaatttggttccaggttggtctgaccctatttgatcatactgaaattctgagccttatttatagcaaacagcagctcagggttacctctcatgactaaggacccatgtcagcctgagttgttaagcaaacccatgaaccctaaaacaaataaaagtatcatttgtcaaccatttactatacatcagcctctaaagtaggcactcatacactcttatcttcataataaacacgtacagtaaataccatttaatagaggaagaaactaaagctccaaaaagtgaagtagctttcctgaggtgccacaactaagcagaagtatgtacactgaggaaagaaaccaatctagtctaacaccaaggtctgaattttttggactatactacaatgcctcatgctacatatacttacacgtttataccagctggtaactgcaacaacaataataatagttaaaagttactgcctgtgaccctagtggggtaggtactattatcatacccatttaccaacaaagactctaaagctcaactcaaatggctattaagtggtggaggactgactcagaaccaggaaagatggctccagggtccatatacttagtcattacctagtactaccattaacatcacaacaccaccaatagttacaatgtcagtgcttataaagcagcagccatgaaataaacatgccgtgtgtgcctcggctagtgatttataattgatacttaccatatttactatgtttactgtacatcaacaaaccatgtgtcatcagagcatgcaaatgacaatatcatcagtctcattttctcagtaagcttctggactccatcattatacctgattatagatacagagactacttaaccaggtatagcttttccactccccagttctgcttcagaccaatgtcagactttaccccagatacaattacttcgaatagaattaaatggagaaagttttttcaactatcttgtttacaggcgttgttttcttagacacttgggcaaaaataaataaatagatgttaagaaaacacttatcaaaaacaagcaaaatgtggattaggatacataattatctggcaaactgagataaaacggcagataggagacaggactaacatgcagctcccacttggatgaacagaacagcatgtggagactcacactgtgaatttttgctccaagaaccaccacaggaacataccgggaaaaccaaaagaattcaagaccctttgaaacaagtggtttgccactgcaaattctgtgaaacagccaaaaactgtgagttcccaaagtgtgagagggaaaaatgtctgcctccaaacacacatcccctctgggaacctgaaaattcagatcacgggagaaggatttaaccttacctagagctgaaatggatttcaggagccaagcaaaatataatagtaccgagaaaagaagcaccggaaagagcgagtccccagcttgagtccagggaagccattcctggcctatctcacagaggtctttggggaagggaaggcacccagcagaactggaggggagtcacagggtgaaggaagctcccggctgaactttgtaatattttcgacaagcatgaattttcctgagcagaatccaggagcttgggggtggtgaacaggaagaacagatatgagcacagccaaaggtgtgagcaggtggggaggggtgaggcctgagagccatgtttgctttctcagcagggaggcttatagcctggggcaagatctcagtcctgctcaccggctgcctggataggaactgatataaagtcagtgctgttgggggggcacagtaggagtgagactggccttgctggcttcatggaagatgggtaaggcctgtggtgttttttttgtttgtttgttttttttttgaaatggagtctcgctctgtcacccagactggagtgcagtggcacgatctctgctcactgcaagctccgcctcccgggttcacaccattctcctgcctcagcctcctgagtagctgggaccacaggcgcccgccaccacgcctggctaattttttgtatttttagtagagacagggtttcatcgtgttagccaggatggtctcgatctcctgacctcgtgatccgcccgcctcggcctcccaaactgctgggatgacaggcatgagcgactgcgcccggccgggtaaggcctgtcagtgctggcttttccctagcgaactgtatgatgcagcagaggcaatcataatccccctggcaacataattccattagcctgagaaccccatagtggccatggcaggccccacccaaaaagagtctgagctcagaccctaaccctgtcctcacctgatggattttctctaccagacctggtcgccaaagacaaatgacataaacccttgggacctctatggtcctgcccatcacctgagaaacccaagtactcatcctggccaatgtagggcaatattatatccccccttctgctactgcagctagtgctttcttgacagggccacctcctggctggagaccaatcaactcaaactgataaaagaacaaccctgctctaaagaagaaaacaactaattccactgcctaaagaagaaaacaactaattccactgcctgcaatatcctggttaaccagaagtactgagtctgttcacatgacaacttcactgctagcataaccagcatttgagaaagccagtgcactaaatgaagctacaaccaaggactcccactttactcccctgccacctccactggagcaggtgctggtatccatggctaggagacctgaacgtggatcacatcacaggactcttggcagacagtccccagcatcagcctgcaggccagtagctccgctgggtggctagactcacaagggcaataacaatcactgcagtctggctctcagaaatccccgtccctaggggaagggggagagcatctcatcaagggaataccccatgggacaaaacaatctaaacagtaacccttgagttccaaatctttccactgaaacagtctacccaaatgagaaggaaccagttaaagtaattctggtaatatgacaaaacaaggttctataacacccccaaaagatcacactagctctccagcaatggatcgaaccaagaagaaatctctgaactgccaaataaacaattcagaaggttgattatcgggttactcaaggaggcaccagagaaaggtgaaaaccaacttaaagaaatttaaaaaacaataaaggatatgaatgaaaaggtctccagagaaacagatatcataaagaaaaaacaatcacaacttctgaaaatgaaagacatacttagagaaatgcaaaatacactggaaagtttcaacaatagaatcgaacaagggaagaaaaaagataaatgaaacaaaaactggctcggtgaaaagataaatgaaattgatagaccactagtgagattaatcaagaagagagaagatacaaataagctcaattagaaatgaaatgggagatattacaattgataccacagaaatacaaaagatcattcatggctactatgaacatctttatgtgcacaaactaggaaacctagaggaaatggataaattcctgcaaatatacaatcttctcagattgaaacaggaagaaatagaaactctcaacagaccaataacaagtagtggtgttgaaagagtaatttaaaaattgctgaccaaaaaaaagtccaggaccagatggattcacagctgaattctatcagacattcaaagaaagattggtaccaatcctactgaaaatactccaaaaaatagagaaagagggaatcctccctaaataattatatgaagccagtactatcacctaccaaaaccagaaaaggacataacatacaaaaactacagaccaatatccctgatgagcatagctgcaaagagcctcaacaaaacactagctaaccaaatccaacaggataccaaaaagataatacaccatgatcaagtgggtttcataccagggatgcaggtacatatgcaagtcaataaatgtgatacaccacataaaaaagaattaaaaacaaaaatcatattatcaactcagcagatgcagaaaaagcatttgacagagtctagcatcctttatgattaaaatcctcagcaaaattggcatagaagggacataccttcaggaaataaaagtcatctgcaacagatccacagccaacattgtactgaacagggaaaagttgaaagtattccccctgagaactggaacaagacaaggatgcccactttcacaacttctctttgacataggactggaagacatggccagagcaatcagacaagagaaagaaataaagggcatccaaatcagtaaagaggaagtaaaaccgttgctgttcactgatgatatgatcatatacataggaaaccctaaagactcatccaaagagttcttaacctgataaataaattcagcaaagttttgggataccaaatcaacgtacacaaatcagtagcactcctatacaccaacagcgaccaagctgataatcaaatcaagaactcaaccccttttacaatagctgcaaaaaataaaataaaatacttaggaatatacctaaccaaggacatgaaagacctctacaaggaaaaccatgaaacactgctaaaagaagtcatagataacactaacaaatggaaacacatcccatgctcatgaatggataaaatcaatattgtgaaaatgaccatactgccaaaagcaatctacaaattcaactcaattcccatcaaaataccatcatcattcttcacagaactagcaaaagcaaacctaaaattcatataaaactcaaaaggagcctgcatagccaaagcaagactatgcaaaaagaacaaatcctgagatatcacattacctgacttcaaactatactataaggatatagtcacaaaaacagcatgctacaagtacaaaaacaggaacatagaccagtggaacagaatagagagcccagaaataaagtcaaatacttacagccaactgatctttgacaaatgaaagaaaaaaataaagtgaggaaaggacaccctattcaacaaatgatgctgggataattggcaagacacatgtagaagaatgaaactggatcctcatctctcaccttatataaataaatatcaacttgatagatcaaagtcttaaatctaagacctgaaaccattaaaaaaaaatctagaagataacatcagaaaaactcttctagacattggtttaggcaaagacttcctaagaacccaaaagcaaatgcaacaaaaacgaagataaatagatgggacctaactaacctaaaaagcttctgcacagaaaaagaaataatcagcagagtaaacagacaacacacagagtgggagaaaatcttcacaaactatgcagccgacaaaggactaatatccagaatctacaaggaactcaaacaaattagcaagaaaaatcaaataatcccatcaaaaagtgggctaaggacatgaatagacaattctcaaaagaagatatacaaatagcagaaaaaatttaaaaatgtttaacatcactatcagggaaatggaaatcaaaaccacaatgagatactcctttactcctgcaagaatggccataattaaaaaaacaaaaaataatagatgttggcatggatatggtgaaaaaggaccaattttacactgctggatggaatgtaaactagtacaactaaggaaaacagtatggagattccttaaagaactaaacgtagaactaccattgatccagcaatcccactactgggtacctactcagaggaaaagaagtgataatatgaaaaagacacttggatacacatgtttatagcaccacaattcgcaattgcaaaaatatgaaaccagcctaaatgcccatcaaccaacaagtagattttttaaatgtggtatatgttatacataatatggaatactactcagccacaaaaaggaacaaaataaagtagagttggagaccactattctaagtgaagtaactcaggaatggaaagccaagcattgtatgttctcacttataagtgggacctaagctatgaggatgcaaaaggcttaagaatgatatagtggactctggagacttgcagggaaggatgggaaggtgagggataaaagactacacattgggtgcactgtatactgcttgggtgatgggtgcaacaaaatctcagaaatcaccactgaagaacttcatgttaccaaacagcacctcaggaggtcatggtttttttcctggtaaagtgacccaaaccttcattcctgaagggtctgggccatttgtagtcctgcccagattgggctgttgtaatttcccattgaccttaatctcagggcatggtaatactatgagacaccccaagggatctcctgtattccacgcatactcttccttatctccattgtggagcagtagactgattttgtcttgatagtctgggtcaatcaccctagccaacactgtaactcccttcttagcccactgacttaaacttaggaggagcccgaagtgtccaggtggcaatcttaacttctagtttaatggaatcattgtgtctcctggtggcagcgtttctccctctggaactaagacttctagaccagcagaacgtaatgtcgcaggaacaggaagcaaaaattttgctagtggatcactaggggtgatggtgagtggtaccacttccacttccatcccttgcttcctggacctatgaatcttggctatgggagaaacagtaccatatattgaatgctgattcagagcatacatggtcttctggagaactttgccgcagccctgaaaagtattgtcacccagttggcattgtaattgtgactacagaaggccattccaccattctatcaatccagctgcttcaggatgataaggaacatggtaagaccagtgaattccatgagcacgagcccactgccacacttctttagctgtaaagtgagggccttggtcagaggcaatgctgtgtggattaccatgatggtggataaggcattatgtcagtccatgaatggtagtcttggcagaagcattgcgtgcaggataggcaaacccatatccagagtaagtgtccattccagtgagaacaaacctctgccctttccacgatagaagcagttcaatataatcaacctgccaccaggtagctggctgatcacccccaggaatggtgccatatcgtgggctcagtgtcggtctctgctgctggcaaattggacactcagcagtggccgtggccaggtcagccttgctgagtggaaatccatgttgctgagtccatgtgtaacccccatccctgccaccatggccactttgttcatgggcccattgggcaatgacagggatggctggggaaagaggctgagtgttgtccacagaacgagtcatcctattcacttgattattaaaatcctcctctgccaaggccacctgttggtgagtactcacatgggatacaaatatcttcatagtttttgaccattcagagaggtccacccacgtacctcttccccaaatttctttgtcacaattttccaatcatgcttcttccaagtcactgaccacccagccaaaccattggctacagcccatgaatcagtatataactgcacatctggccatttttctttccatgtaaagtgcacaaccaggtgcactgcttgaagtcccacccactgagaagatttcccttcactgctatccttcagggatgtcctagaaaggggctgtagtgctgcagctatccactttcgggtggtgcctgcatatcgtgcagaaccatctataaaccaggccctagtcttctcttcctctgtcaactgataatagggaactccccatgaggccattagtgcaggctgggggagagacggcagggtggcagaagtgagccacttctgcctttgagccacttcctcatgtaacttaactgtgccttcaggacctgctcgagcccaatcatgtatataccacttccatttgatgagggaatgctgctgtacacaacctactttatggctagatgggtcagaaagcacccacttcatgataggcagttcaggtcacacagtgacttgatgacccgtagtcaaaggtttggtttccaccaaagcccagtaacaggccaagagctgtctctcaaaaggagagtagttatctgcagaagatggcagggctttgctccaaaatcctagcagcctctgccatgattcagctatgagggcctcccagaggctccaaacaccatctctatctgccactgatacctcaagcacaattggatctgctgggtcatatggtccaagtggcagagcagcttgcacagcagcctggacctgttgcagaaccttctcctgttctggatcccactcaaaactggcagccttttgagtcacttgctaaatgtgtcagagtaacacaaccaaatgtggaatgtgttgcctccaaaatccaaataggcccacaggacgttgtgcctctttcttggttgtagaaggggccaaatgcagcaacttatccttcaccttagaaggaatatctcaataggccccataccactggacccctagaaattttactgaggtagaagttccctgaattttggttggatgcacatgtctcaccaataagtccagtgtgtttggtacttcttgctcactggatccaatcagcataatgtcatcaatgtaatggaccagtgtgataccttgtggaagcgaaagagatcaaagtctcttcgaacaagattatgacataaaaccagagagttgatatgtccctgaggtaggacagcaaaggtatattgctggccttgctagctgaaggcaaattgcttctggtgggccttatggacaggaatggggaaaaagacatttgccaaatcaatggctgcataccaggtaccaggagatgtgttaatttgctcaagcaatgaaaccacatgtggtacagcagctgcaattggagtcaccacttggttaagtttacaacaatccactgtcattctccaagatccttctgtcttctgcacaggtcaaataggagacttgaacagggatgtgatgggaatcaccacccttgagactttcaggtccttgatggtggcactaatctccacaatccctccatggatgtgatattgtttttgatttgctatttttctaggtaggggtagctctaatggtttccatttggcctttcccatcataataactctcaccctacaagtcagggagccagtgtgggggtttggctacctgctacgtatgtctatggcaattatgcattctggcactgggaaatgaccacagggtgggtccctggatttccttccaaggaaggaagtcagacctgtaagtcagacctgagctaaaactccattaattacctgatctccataagcctctacttcaactggaggaccacaatgacattttgggtcccttggtatcaatgtcagctcagagccagtgtccagtagtccccaaaatgtctgatcatttccctttcttcaatgcagttaccctggtaatagactgggggtctccttggggaaggatgggagaaatattaacagcataaatagtcactagcatagtggggtccttttcaaggggacccagcctccccttcattcaagggtttctgggcctataaattttgtggtggagtgactgttgttcccaccgttagatctgacatacagagaagagcaattacaggactcttcagagatgcagttgccgccatcacaaatccatttcgcaaagcgttggtcaagggtgtatcttctggaccctcccagctgggatgggtaggtccaaagtgaccaatccactccagcatccaatctccctaaacttttggatcccttcctctacattaaactgagagagatcaggcatttccagcttgctcacagtgggccatcttttatccatatttcagctaaccaagcaaataaactattagaaccattaaaaccttttttaactccctgagctgcaacatcaaaagcagaatctctacttagtgggttcaaatcaataagtccagcctgatccaactctatattccttccgccattatctcacacccttaatatccattcttatgactcttctccagatttctgcttatataaattagaaaactcaagcagttcttttctagtgtagcacatctcctcaagggtcactctgaacctcacctctaggggtctgctgggactttagtctaggtataggtctagaagcaaacaggggtgttgggggtggctcctgaggagaatcaacgttattttgcctggcaactgcctcagaggaggccatcactgttgcctccaggcagcgcatggtttatctcctcagacaaaggtggaaaggctgatggcagcatgtgttggggaggggatgttgccactactggggatgaagaagctgtttcttctggcaaaaaaggttcatcagagttaacaagctcagtgtccccagcttcattaggccctccaccacacatccccattccaagttgcagggtcccattcttttccagtcaatcccctcactttaacagtagacacctggaaaggctgtgcatgcacctttcgttgcaggtcagccactcacatgataagagcttgtgtctatttttccacaatttcagctctttctctataggagataagactcttacacagggtaatctagcaggtgtgaggctcagtactacttctgaagctgaaaatgaatccctgagctcatcatttttctttcatcactttgtccagtgaacgtaggagcaaccaaccagctttattatgttccttggttctccacatatggtcaaaggtattatgtttcaagtcactaaactccttgcctctcacgagcagtgaatcaggagtatcagatgcatttattttgcataactctctaaacagttcatgccaaggactatgggtgttctccatactattagaaatagaattcttaggccgggcactgtggctcacgactgtcatcccagcactttggcaggccaaggcgggagggtcatgaggtcaggagatcgagaccatcctggctaacatggtgaaaccccgtctctactaaaaatacaaaaaattagctgggcgtggtggcggtcgcctgtagtcccagatacttgggaggctgaggtggcagaatgccgtgaacccaggagtcagagcttgcagtgagcagagatcgcgccactgcactccagcgtgggtgacagagcgagactccatctcaaaaaaaaaaaaaaaagaaagaaaaagaacctttagcattttttggtctaatcacattaagcagccaactccagaaaccccaaaaccaataaaagaactccatccttaatattctgttcctctagaaccacttctggtaccaaaatctgtattagtcagggttctctagagggacagaactaatgggatatatatatatataaaggggagtttacgaaggagtattaactcacatgatcacaaggtcccataacacgccatctgcaagctgagaagcaaggaagccagtctgattcctaaaggtgaagaacttggagtctgatgtttgagggtaggaagcatccatcatgggagaaagatagaggctgggaggataagccactatagtcttttcatgttcttctgcctgctttttattctggctttgctggcagctgattagattgtgcccatccagattaaaggcaggtctgcctttcccagtccactgagtcaaatgttaatctcctttgacaacaccctcacagacacacccaggattagtacttcgtatctttcaatccaatcaagttgacactcagtattaaccatcacaatgtttcattcagaagctatagtctccaaacttcagtttctcctctgtcaaataggatcttcagctatgattcttacttcaaagggtacacaggtacaagagatccccagcccacgagtctggcaacatgttttggtcagccttaacattatctttttctaaaatccttaaattagtaaatattgcttcccatctaacatagctctaagtgaaaaaagttgcagtttaaggagagtcctaattttctgaccaaagagactaaaacttaaaagggaaaacaagacaaactatttgcttggcccactacaagtcccaggcattatgcaaggttttcaaggagacacagagacaagtgacacctgactgaagtgtagcggtggggttcccaggactggacctcatgaaaggttagaataaatgcctgcagacagattcctagctgataggaagagtcagaggagatcacacttgctcagggagtgaggctgggcagctacatggttccactgcctctgagatgaagccaggaggtgactggagctgacatgtggaagaggcagttggtgaaaccttttctgcatgggtttgatccccagcttaatcctaatacctgtgagtctttgtgaagctcaaaaaacatctctgtacacctgttttctcagttcttgaatggagatagtaatcatacctacatgcctcacaggatcagtacaaggagtgcatgagacaattatgaagagtgcttagaacagttcttggtacatagtgtgcactcaaaaatgatagctatcttttctattacatgtactgatctgaaatgatgtctaagatatattaagttaaagaaaaaggtcaatataaaactatatatatatatagaatgcaatcatctgtggggggaaaatacatgtatctatatatgatatctgtctgtatatgtttataacatctatggaagaatacacaagaaaccggttaatcatggttgtttctatagaagggaactggacctagaagacagggatgcttttcataacatagcctacctttaaaactgtttactattggccaggcaaggtggctcatgcctgtaatcccaacactttggggggccgaggtgggcggatcacaaggtcaggagttcgagaccagcctggccaacatgatgaaacaccatctctaataaaaatacaaaaattagccaggtgtggtggcaggcgcctgtaatcccggctactcgggaggctgaggcaggagaatcacttgaacccaggaagcagaggttgcagtgaggcgagatcgtgccattgcactccagcctgggtgacaaagcaagactccatctaaaaagaaaaaaaaaaacccatttgctatttatatcctttacctgtttctaaatgtcattaagattaatttatctctttttttaaaaaaaagaaaacaatgagctaggttgatagcggtagaaatgttaaggaatggttataagacagtatagatgggacttaaaagatccagtacctaacaacagacgtgagaaaaaaaaacaaaaaactgtaaccaagattctaggcttagtttcctgagaaaatacttatgcttttattataaataggtaaaataagagaaagtaagggttgggagaattgagagaagaaatatttggatatatggagtttcatatgccatgaagacattcaggtaggagagttgaacagaatttctagctggaaatcaagtgagatgtggtggttagacacaagcatttcagcaattgtggcacagaagtgatggctgaaacaaagagaattccaagagacggagaatacagaaagaagtgatatatgaattaaccctgagaaaatgtttacattttttgagagcttttagcaaatggggtgcttttagtggcatattttgaacaaaagtatattgtactcatgtctctattttcatcagacacatttaaattaaaataactgttccatttgtttactatttactgtttctgccaataggcagcgtgcaatggtgaaaagaacatcggggtttgaatccttgctccaccatccattatatgcatcatcttaggcaataactttgctgagcctcagtcactgtgaattattataccttttccagagggttgttgctgaaattatatgaacaagtgcacatgaaagggccaagaaaagtgcatcacacgtggaagacataaaataaatgttacatgaaaatgaattgtataggctgactacatgcattaatacttatacatgataaggaccagccaacgcttacctaaaaatttagctctcaggtggtcctttgattttcagttcggggccacgcaaagcaaatcctcccataccctaaatacacctcatgtggcatcaaacaagaaagtatatgtccaggtttaaggatcaggattttttaaactatctgttttttttaaatgagggcttaaaaaccttggacttctctcttcccagaaattgagcaacattattaattgatgactatttctgtttaaattaaatttcaaatgcagagtcattagctattttatctccttaatgtcacacctgatagaagcagtcaaacttttttttttaattttactttaagtcagtcaaacttttagaagaagacatacatatctttaaagggtcatttcctaaaaagcttttgagatcatttcacatcataaaatgatcacgtaaagccaaatatttccttagttttttttttatttaaaaaacattttttatcattctcagtattcaaacaaatatttcatccttacaagtcttaagatctctgtggaaggttagtataacaaccagaaaaccttctgttttgagaaaaaatgtatgtttagtcattttggattataataatgggactctcttctctgaaacacatcaaaaatatttcacaagtcataatggttctgtggttatgttgaagaaaaaggaactccctatcttttaaagacccatactgaaatgtttgtggatgaaataatgtgataactgggattactttataatactaagggcgccaggagcagcggttcacacctgtaatccctacactttgggaggccgaggtgggaatatcgcttgagcctgggagtttgagaccagcctgtgcaacatagggagactctgtctctacaaaaaagaaacaaattagctgggtatggtggtgtgtacctgtagtcctagctacttgggaggctgaggtgggaggatagcttgagtccaggaggttaagcctgcagtgagccatgaccacgccactgcacttcagcctgggtgacagagtaataccctatctcaaaaaacaaaaaaaatgataacaaaacaaaataataagggatggcatagtggatagagaagaaacaaaattagccacgaattgatcatgttgaagccaggtgatggatacatgaaatttcattttgcaagtatctctattttactatttgtttgaaattcacccaaagtttaacaaaattcacatagaaactgcttatttgctacttaaagaatacaaaagtagaatgtacactgatgcacatatattgttagaatgtacttatgagtgataacctgcagattggagactccatagacagactcatggctccttagaaagaatgattgtgggtggagcagacccaaggaggaaaagcagagtccaggcttagactgcagcttctcgcttacctgtgcagtctaattttgagcggcctctttgtagttaagagacaggagctcccattctctctctactaacccaaaagtcttgtgtgtactccttgccttggctcagctccaaacacatttctacaccgataacaagaaatatgctgtaaatgatgtttccttctcaatccctgccgcctctgaatttgctgaccttagtaacatcatcaataaattactaaaggacaaaaatgagttccacaaacatatggagttttatttccttattaagggccagtttctgcgaatgtccttggtcaaacacatggaactggagaacatgtcatcagaagtagttgtggaaatagaatatgtgaagtacacagcaccccagccagagcaatgcatgttccatgatgactggatcctttcagttaaaggggcaaaggaatggatcttgactggttcttatgataagacctctcaaatccggtccttggaaagaaagtcaataatgacaattgttggacatagggatgtcttaaaagatgtggcctgggccaaaaaaaaagatagtttgtcttgcttatttgtgagtgcctctatggatccaactattctcttatgggagtggaatagagagaaacaaagtgaaagcccgaccgtgctgcagaggtcatgctggaagtgcagagtctatagctgttgatagctcaggaactaaattttgtagtggctcctgggataagatgctaaagatctggtctacagtccctacagaagaagaagatgaaatggaggaatccacaaatcgacagagaacacagagcagctatgactcccatagtgaccctctctggtcacaaggaagcaatttcctcagttctgtggtcagatgctgaagaaatctgcagtgcatcttgggaccatacaattagagtgtaggatgttgagtctgacagtctgaaggcaagctttgacaggaaataaagtgcttaattgtatttcccattctccaactttgtaaacgtttagcatctggaagcacagataggcataccagactgtgggatccccgaactaaagaccattctttggtgtcactgtccctaacttcaaatacaggttgcgtgacattagtaaaatggtctcctacccatgaacagcaactgatttcaggatctttagataacattgtcaagttgtgggatacaagaagttgtatgatctggctgctcatgaagacaaagttctgagtgtagactggatagggacacagggctacttttcagtggacaagcagacaataaattgtattcctacagatattcacctaccactttccatgtgggggcatgaaagtgaatgataaattgatcatagagattctttatacaaatgaacttggtagaaaatcatgaaattatactgatgcagatgcagaaagcagccgtttgaaatttatataatgttttcactcttcataacagctaacatttaactatctttttcttattttgtatttataatagtttgtgtttataaaataaaaagaatgattgtgactagcttgttaatcacatgtatagctactatgatgtactcttacagtttatagttaattaacttacacatctaaaatatatctttctctggccatttgtcccaattgcatgtgaagaatataaggtaataataaaatttacggaaaaagtactaagtatctgttgcctaccactttttagtatatgtgtatatttatatacttataatttttattttcaagtgtagattttgaataagaacacatctttataatggggtgtatgaagctatttgcaataatcctggatctatatttacagacacagacaaatatattcatgatatgttttaaatgttaaagtagctaataaaaccaccttaggggatgatttcatttttatgttatatttgtctctatatacttagaaaaaaatgtggaaagataaacacttttttacagtggtctttttctgctttatattatgtgttttattggtttttcttccttctttatattttctgtatttcttttatccaatgaacactacataaatacgtatttttaaaagaattttaatcatgtaacctttctaaagattaaaagagaaggaataacaatattatatcagtatatgcgaatttagtgcatgataaaagtaatatatcagcggacaaaagagaaattcttcaaatcatgagttataggcaaccaattaactatttggaagaaacctcaaatgaatcaaaattttaaatataggaactataaagatagctgagaggaattatttttaagcaaactaccaaagacagaaacaatcataaaaggaaaacaaaagatttcaacatacacagctttaaaacatccatatgacaaaatacttcattaataaatgggacatttggggatttagttttaatttgaatttttgaaaatatataacaaaggggccttataaatctatattaaagaggccacccatggtggctcacacctgtaatcccagcactttgacaggccgaggtgggcggattgcctgagctcaggagatcgagaccagcttgagcaacacggtgagaccatgagaatcgcttgaacctgggaggcagagaatgcagtgagcaagatgatgccacttcactccaacctgggcgacagagtgagactctgtctcaaaaaaaaaaaaaagaaaaaaaaaatcaccattaaagataaatagccaaaagaagatgaattagaaatgcccatgtcaccaataaacttatgaaataaacgtataaaggtatttgaccttactagaaaataaattgattttgttttgtttcttaaataatattcaaatctagcacctaagataagcactctgataaaataatggtggcagtgtacaactggtacaatgtttatgaaaagcaacttagaagcacgtactaaatgactaataaaagtacatatcctatgaatcagctatttaacttttaaatatttgtctaagaaaataaagatgtacagtaaaatttagttaaaaggatcctcatcagaaaaatagaaaaaaatggagtccaatctaactatccaacaataagtaacagattataactgatggtaattgtatataacataatttttaaaaagccactaaacatggtttatagaaacctgtttaatgcaggtaagagcatcacaatacattaaatgtgaaagagttgttatttattttattttatttatttatttttttttttgagatgtagtcttgctctgtcacccaggctggagtgcagtggcgtgatcttggctcattgcaagctccacctcccgggttcatgccattcttctgcctcagcctcccgagtagctgggactacaggtgctggccaccacgccggactaattttttgtatttttagtagagacggggtttcaccgtattagccaggatggtctcgatctcccgacctcgtgatctgccgccttggcctcccaaagtgctggaattacaggcgtgagccactgtgcctgcccaagagttgttaagctgtatatttaatacttataaaagtgtatgcattaaaaaaattagaatggatgcactgaatttttactttaatagtggttatcctgctcaatgaaataaaagagaacacaaacaaatgcaagaacattccatgctcatggataggaagaattaatatcatgaaaatggccatactgcccaaggtgatttatagattcaacgccatccccatcaagctaccaatgactttcttcacagaattggaaaaaactactttaaagttcatatggaacccaaaaaaagcccacattgccaagacactcctaagccaaaagaacaaagctggaggcatcacgttacctgacttcaaactatactacaaggctacagtaaccaaaacagcatggtactggtaccaaaatagagatatagaccaatggaacagaacagagccctcagaaataataccacacatctacaaccatctgatctttgacaaagctgacaaaaacaagaaatagggaaaggattccctatttaataaatggtgctgggaaaactggctagccaaatgtagaaagctgaaactggattccttccttataccttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaacttgacaaatgggatctaattaaactagagagcttctgcacagcaaaagaaactaccatcagagtgaacaggcaacctacagaataggagaaaatttttacaatctatccatctgacaaagggctaattaatccacaatctacaaagaacttcaacaaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcagtaaacaacaggtgctggagaggatgtggagaaataggaacacttttacactgttggtgggactataaactatttcaaccattgtggaagacagtgtggcaattcctcaaggatttagaactagaaataccatttgacccagccatcccatcactgggtatatacccaaagtattataaatcatgctactataaagacacatgcacatgtatgtttactgcagcactattcacaatagcaaagacttgtaaccaacccaaatgtccaacaatgatagactggattaagaaaatgtggcacatatacaccatggaataccttgcagccataaaaaaggatgagttcatgtcctttgtagggacatggatgaagctgcaaaccatcattctgagcaaactatcacaaggacagaaaaccaaacaccacatgctctcattcatagtgggaattgaacaatgagaacacttgggcacaggatggggaacatcacacactgggacctgtcatgaggttgggggctgggggagggatagcattaggagatatacctaatgtaaatgaggttaacgggtcaacgggtgcagcacaccaacatggcacatgtatacatatgtaacaaacctgcacgttgtgcacatgtaccctagaacttaaagtataacaaaaaaagggaaaaaataaaaaataaaaataaataaatatataaaactgttgggggcattagtcacatgaacagctgtcaaaaaaaatagtggttatctctgggagtgatgtttccaaccttcttcttacttatctatatattttaatgttggcatacagagactatctaaaaaaaaaaaaaaaaaaaaaaaaagaagcagttgcttcaaaacttacaccagtgagaaattccacagaaaagctgagaacattcctaacaagggtccctttatgtatgcacttaacataacatatggaaattatttagttttctgcctcactaaagtggcctcccacaaaataggaactatagtctcactctcaatttctttttttattcctaatgcctattacactgtgtggcataatagcaggctgagggccaggcacggtggctcatgcctgtaattccagcactttggaaggccgaggcaggtggatggcctgaggttgggagttcaagaccagcctgaccaacatggagaaagcttgtctctactaaaagtacaaaattagccaggcatggtggcacatgcctgtaatcccagctacctgggagactgaggcaggagaatctcttgaacccaggaggcagaggttgcggtgagccgagatagtaccattgcattccagcctgggcaacaagagcgaaactccgtctcaaaaaaaaaaaaatagcaggctgaaggaataacttttcacagagaacccaaaagactctctaagaaaccaaaggtttagattctgtacagaaaacccagagaatcacctaggaaatagccaagactagccacagaatctctcactaaatacaaatttcatttaaccagctcagataaaaaaaatcctggtattttcctgcacctcccccttctgtctcccaatccattaacaaatccaactgaagaaatcctcttgtttctacatgtaaaatgtgttctcacaaccattctcaccatttcactgccaccatgcttgtccaagccagaagtcatctcttgcccatacatagaccagcaatagtcccctggttggtctccaggcttccactctcctgcactgtagccttcacacaacagagtgacctttaaaaaggcaaatctaatcatgctactctaagctcaaagcctccaataacttcccatcacatgtagaataaaagccaaagtgtttcctatggctcacagcctttcatgatgtgccctagactttgaactcctctcctaccctctggttcccaggtctccagccacactggcctgctgactattcctgaaacttgtcaagctcgttcctgcctcagggcctctatcctccccactcctgtgtttttcctctttgctggaaatgcacttctccttaaaagtgaccttttcaaacaggtctttttgtttagaagtcaccttatcaaaatacctatcttgaaccactttttaaaaaatagcaatgctttccaaccagccttcactgtctcttcctttaacctgctcaatttttcttcagtgtgccacctgccttacattatttattaatttggtatatatgtctatctcctccattagaatgtccattagggaaaggactttgttttctttaccactcgatttcaagtacttagaatagtgcctgccacattagaggtacaaaataaatatgagataattaactaggtgaatagataaataaatgaatgatatcaccaagatatgtttcaagttcttacacaaacacaatatttggcccagtgtctactataaacggtagaatatttcctcaagtcaacaccaaaaagggatgttataataaagcaggtcggacaacagtctcacattactgaataacgatactgatctgatgttgatgattgcttctttactttttttcttttttttttttttttgagagagggtgtcactctgttgcccaggttggagtacagatcacggctcactgcagcctcaacctcctgggctcaaacgatcctcccacctcagcctccctcgtagctaggaccacaggtgtacgccaccacgcccagttaattttttaattttttgtagagacagggtctcgccagttgcccagactggtctaaactccacctacctctgcctcccaagtgctgggattataggcatgagccactgtgcccagcctgatgattattttcaacaggccttgtgtttcctaagccccaaaagccttcccatttctcattccactgccatttgagacccatggccacctgattgaaacctcaaggttttgctaagaatttatgaagagagttaagaaatctcttcaaattgttcctatgaggaagttatttcatactatgagcaaattcattttcattaagtatctgttgtaaccaaacgttgtttcttagcttcttagctctgtaatatggcacaataatctgacttactgaagccactcattatttcccattggcttaattctttctttcttttttttttttttttagagatagaatctctctatgttggccatgctggtcttgaactcttggcctcaagaaattttcccacctcggcctcatagactctttctatgttggccatgctggtcttgaactcctggactcaagggatcctcctaccttggcctcccaaagctctcacgtaccagcacccattggcttaattatttcagtaaaatcaggcaaggaggaaccctacaaaataaacacaggcattctcaaagcagatataagtgaaaactcagagtatactgtggtcagctgtgttctctatcacaagtagtttgtcaacttaaaataaagtactaaagtttgggaatgatctactctaaaaatacatcggacaatggtcaatgtcatttacaacattcacctcctttctgatacacatctcaggaaaaaaaaaaaaaaactactaagtaccaggtcagaaatttggcacaaccctagatgaccaccttgtcatgcaaataaacttagaatggtgctcctgaaagtcagccacagtgcttcaaaaacacatgattttttaaaacaccaaactaagcataccacatagtatagagaccaggctatggagttgagaccacctgggttagaattccatttctttccatttagttgctgtcaccttcctaatttctctgtgttccatagttccatattatccataaaattcagatatgaacacttactatacagagttgttatgaggattggacaatgtatgcatcccacaagtagatcaattacaagtacattttgccccaagtaaagacaacacgtgggaacgctgtgcaagagggaacagcaaaagcagttggaggatggaagtcagtttgcaaacctatgcgcacaggcagccaaacacgaaaacgttccccacaagtagtctgtaaattggagactccattgggatacacacacacacacacacacacacgccctgagaggaaatagcacctttcttcatcaccaagttagccttaaaaattatttacccgttgttagccacactagcactgacaaacccaactttactcttgtaggtcattctccacaacgtctgtgctgcgtcaatcccaaatctgactccctgacgcttaacagcgaaaataaaaaaccgagacattactcaatagagttaacccttacttaacaaaacgctgttgtcccctgtggcgtgcagacagtagagacagtaattcccgaccttatgcttgtcagtgacggcatgccctttgtatacacgcttcagtagagaacgactgcagtaagtaaactgctagtagcaacactgttcccctatctaaacttcccctttccagagttactgatgtcccaacatgggtcggtcgctcagtctccgtcaagcccgtaccccatagcttgggcatttccccccgcagatcacaagatgcaaaggggaagttactaccaaaccgacgagaatggcccagagctgggggctgccaggcggttcctgggcccctctcagcaccagaagaaggcgggcgcaggctcgccgcgggtcggccgcacgccatacctggatcaggccctgctggaacaaggcgctgtgcacgcagccagggaccgccccgggcagctccagcgagccgttcccattgcagatgctccagttgccacgcaagctgtaactgagctccgcggcggtggtgcctgcaccgcacagcgcgagcagcaggagcaggtggaggcgcatcttgagatcccgcgccaccgagatgtggagagatcgaaaggcagcgctgcaagggaccggcggtgaagccactcaccccctcggaagtagccgaggcttt

SEQ ID NO: 485 - DNA, 130350 bp, Homo sapiens
taaatttaaagcccattttattttgggtggaggctaacatgttattagtgtctttgtcacatttatacactacctttctcaatttgaccatagctgcctaaaaattgctttctgtttctagagggtatataggacaggactggtaaataggagaatggggtcctagactggcaccatgatggtctcacactaatcttttacctcaggaaatggaattaagaatattcatccacagaggtatagggtgagcttatgaaacttgaagtggcggaggcagatttggaattcctgcgagagcagccattgaaacttgggtctcttggcgttgctcttttcttccgactggacctggtggtgtctgcatcgttggggtcaaacacgactgtcatggactccattctggtcacggtgtacatactgctttgccggtttggatgaaacctggtggtcttgagctctagctcatcatagctggaaactttgatgaaaggacaccagcgaaatgctctcttgaagccagctcgaaatctgaggaaaagcaggccacagaaagaaaaagttattttttcaagcagatatgtctttcagctgccacagaaaattctacctaaggcagttataacaactcagtttttgagtttggtttttagccagactcttagaatttatgtcacagtactgttgttagtcgtttagttcttgtttgaattgaatcttaatttcccattaatgagaagcattgattcccagcaatgaaaagcatctcattcccatcagtgagaagtcatcaatagcgaatgcatagcatcaggtaatcaatatgttaaagaaacagtacatttttctaaaataattgtatacatttacataaatataattgaattaggctggccagttaaggcacttaaaaatgatatatttcaaaatagtttctttcagaaatgattacacatttataaattaaagtctcgtttaatgttagaattgctaatcttgatgatttttatctaattatatatgaaagtgcaaaatccttaactttgtaaaccattaaatgaagttaattaaaagtggatgtaatgcttgtggggtgtcaggaattgagatatggcttatgcaattagtgaaaaaaaaagcaagagttaattaagtatttaacaaacttaaggcacagtgtggtagaaccccaactgagaagagagcttaggatttaattcatgcagttacttacataaagtcccaattctacttgtgaaaaaaacacattggtttattacaggacttacgagccctatgaaatttaaccctatcccttcatgtgctgaccagtacaaccaaggtgtttttatctggaaagcagattttatcttttttttctagtcttacatttgactacaaatattctcacttttcattttttaactttataaacatctttcccttgaccactgtgatttcttcacaagccatctccatagaggctgcatgctctcttactcaccccacctcacaatgcaggaaggaggattggagttcccattgtttttacaaaaccttctacttcaaagtttatttatttacaacatatcctttttaataaagtccgctcacatatgccatcatctctccatcttatagaaattattcaagaatttctaggaagtaacttcatttcattgaggatttgagcatattttcaattctcctttaatcatgagggcacttctttttctttggcaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaaggtgggtgtgacaagcaacttgcatttcgtagttttgtttttaccttttattcagacagcagtagatgatgggattgtacatggttgagctcattgccagccaaaagctagccaggtagacctgctggatgtatttccatctatttagttgttgatagattgcagtgagaatgaagtaaatatgatagggcagccagcagatagcaaatgtcatgacaacaataatcatcattttgacaacctataaagaaaaaaagtcatttttgacaaatataatactcataatagttccaatagcttattgcaaatcatgcttttctgccaatacagttaaatacacatcatgcctagggaatagtcaatatattaaaaaatggtgaagcaatatacggacagttgcctaaggtaagtctcaagaaattatgctatgtcactattcatttctacctatctaagtgaatgggtagtgctaactcaaacacggacaaatatattttgattggcctgaagaaaatcagtgtttacaaaaacccagagagcctggaacagagagagataggaactaggatgtggctgtgtagcctgcattgtacgatagtggagatattatctccaggaaatcaactgttaagtcactatggaggtttactaggctgctagggctgggtttgttcaagtcagtactcttctatagcctgactatagcttaagactatttagatttctttaatagcctgctcactacgtaaccttatgaatattaatttggtttctcttataatctgatattggggaagatttccccaaatagtgattatgtgtaaatattcacgttagtgtgaggaaaatactaacttgagatttgcaaatagattattggtttatgcaactgttttatgcattagcttttatgactttggtaagcataagccatttcctttgattgtatacttgtgaatgataatatcctggacagctctaatcaaagtagaatgtcagctgttatttctcttccactaggcctaaaattcctgaagacagaatgtcttaattatctttttactcccagcatctatcacagtccttgatatatagctggagataaatatatataggatgaatgaataataaatagcaatgtacaatgaacaatgttcatatctcttttgggaatttggaaatagtaaaaagtttaaaataagatactttaagctaaacaattttgaagcttacctgcagtcagattaaaacaaatcagggaaagctctgatgtaaagggcctatgaggcacctcagaactaggaagatacagtatttatgaaatggacttgtcatttgactgcaaattagggattcagatgaaggttggcaaggtttagtcaggagagacatgattttagaaataggcaaagcatgaaatggatcaatgtggaaggtaactcttccctaagggccaaatcactgtaccatccaggtggccagcattgagcagatggaaattggccatcagagttgaaaatccaggtcaacagctcacaaaatgtcatcactggccacatcacataatatcttttgattttcccagtgttctttaaattacattgctttcttctgaagaactgcttttgtatttctgcattttatttctcagatttcctattcataattcatatatttgtgaaaaacaaatgatttaatttacatttatgcaatattttacgtatttaacaattaattaattgtctttcaattgcgcattaggaaattgaggcaaaaacccaaagatctgaccactgtgattcatgtaactaagatctttcttgtctttttaccctctatttacagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgcctactaactgtaggctcagaggatattagactaaatgaaattagtctactgatgttttcattgttgaatttgtgagcattctactattccttgaacagggtagttaagctccagccatagattattttccctggctcctccctctacctagaacactcttctaaccatgattcccagggcttaagtacctcacctccttcaagccgttgcacaattgtcattttttctttgagtgctattctgaccaattaatttaaaatcacagtctgcccttccagccctcccagaacctcttagcttgctctttctcttcagtttgttatgttttttctttattttgtgtctcctgatgctggactacaaaagagcaaggattttctgtttgttttgttcatttgtatatttcgggcacctagactggacttcatacataaagggtactcagaaattttttaaatgaacaggtgaaagtgactataaaacaaaagaaactgaaagacgcagacagttaagtaatgtctaagattttagtcagttattactagtatcatttggttttcatttaagatggacatgtgtatgtaaaataagcatggaatttactgctatttctgctttcaaggcaaacaaatttaaaaagagaatgagtccaaaaataacctttttttttttttgagacagagtctcactcttgtcacccaggctggagtgcagtggtgcgatcttggctcactgcaacctctgcctcccgggttcaagtaattcttctgcctcagcctcccaagtagctgggattacaggagcgtgccaccacgcctggctaatttttgtatttttagtagagacagggtgttaccatagtggccaggcttgtctcaaactcctgaccttgtagatccacccacctcggcctcccaaaattctgggattacaggtgtgagacactgcacccggcctaatataattattttcatggggcacatgaaagcattagatttcattctaagcaaatgttaagagcaagtaaaatatctttgagaatgttaacatatattgtatttgaatcttttatacagactgactacaaactccctatgcacaaaattgttttccgacaattgctgaaaacctactaaggctatcagtccttttagataaatttcaattttcatagtgcaaaaagttcagaaaaacatgcaaaaattaaaatgcatgtggaaaatggaacagagacttcagatagcttttaactcacatacagagggcctttagaacttcttgcgaaagatttataaacatattttaaaaattttaagaaaagcttaaaatactctacagaaatgtttataagtgaaacagctgctataatatattttctgtacttatttctatataatactgttaccttggcactctgcttacaaaatcttgtagtgttatttcagatgatgaactctctggactctagttttgatgtgaatgcaaacgtaggctcttgggtgggagaaattgtcttgctttgtgaaatgctgaaatcacaaaactgaaatcaccctcctgataaaatgccaaagaaaagagctctttgaagcatgaagcttgagcaatgatagatgtgcaggtgctatgagcagttaccactgtattgcatggctgaacaatggtactagtgcaggcaggctatgaactgttaaacagaaaaaagaatcaggtggtaaactttaagaaattcttgagatttttaggcaagatgacaatctgggacagagaaggttcaaatctctcatcgtgtcttaataatgttattaagtgggtagccacccattacccttggaaacttacaagcaggataaaggaggaaagtggggacatgtaatgtagcccttacaaagttacattgcctatttttagcagttaagaatctaactacgtaggcaggatggaactgcatgtcctcatatattagtgagaatgaactttggataccattccttcatgtatcaaaggggaaagatcttagatttttgtataccgtacagattagaactgaaatgcctacagttgttcttattcattacattaaattagtgtaggatggatgattttgaggtttgggttgtaaaagcaaaaattagtttaggaaattaactaaaatgctgacaactatttagaaaactctaggggtcatattcttttttttttaattttggcaatattatcttctaattattttatttttattattatactttaagttttagggtacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctgtgtccatatgttctcattgttcaatacccacctatgagtgagaatatgtggtgtttggttttttgttcttgtgatagtttactgagaatgatgatttccaatttcatccatgtccctacaaaggacatgaactcatccttttttatggctgcatagtattccatggtgtatatgtgtcacgttttcttaatccagtctatcattgttggacatttggggtggttccaagtctttgctattgtgaatagtgccgcaataaacatacgtgtgcatgtgtctttatagcagcataatttataatcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaaagattgccattctaactggtgtgagacgatatctcattgtggttttggtttgcatttgtctgttggtacaggattgattctttctaaatgcttggaataaaaatggtcagctaggtgtgacaaaaaacaaaacaaaacaaaactgcttgttttgattagaatcctttttttaaaattttattattattatactttaagttttagggtacatgtgcacaatgtgcaggtttgttacatatggatacatgtcccatgttggtctgctgcacccattaactcgtcatttacattaggtatatctcctaatgctatccctcccccgtccccctaccccacaagagtccccagtgtgtgatgttccccttcctgtgtccatgtgttctcattgttcaattcccacctgtgagtgagaacatgcagtttggttttttgtccttgcgatagtttgctgagaatgatggtttccagcttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacacatgtgtgcatgcgtctttatagcagcataatttataatcctttgggtatatacccagtaatgggaaggctgggtcaaatggtatttctagttctagttccctgaggaattgccacactgacttccacaatggttgaactagtttacagtcccaccaacagtgtaaaagtgttcctatttctccacatcctctccagcacctgttgtttcctgactttttaaagattgccattctaactggtgtgagatgatatctcattgtggttttggtttgcatttctctgttggtacaagattgattctttctaaatgcttggaataaaaatggtcagcttggtgtgacaaaaaacaaaacacaacaaaactgcttgttttgattagaatccttttttttaaattttattattattatactttaagttttagggtacaagtgcacaacgtgcaggtttgttacatatgtatacatgtgccatgttggtctgctgcacccattaactcgtcatttacattaggtacatctcctaatgctatccctcccccgtccccccaccccacaagagtccccagtgtgtgatgttccccttcctgtgtccatgtgttctcattgttcaattcccacctgtgagtgagaacatgcagtttggttttttgtccttgtaatagtttgctgagaatgatggtttccagtttcatccatgtccctacaaaggacatgaactcatcataatttatggctgcatagtattccatggtgtatatgtgccacattttcttaattcagtctattgtttttggacatttaagttggttccaagtctttgctattgtgaatagtgccgctataaacatacgtgtgcatgtgtctttataacagcatgatttataatcctttggggatatacccagtaatgggatggctaggtcaaatggtatttctagttctagatccctgaggaatcgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgagcattttttcatgtgtttttcggctgcataaatgtcttcttttgagaagtgtctgttcatatccttcgcccactttttgatgaggttgtttgtttttttcttgtaaatttgtttgagttcattttagattctggatattagccctttgtcagataagtaggttgcaaaaactttctcccattctgtaggttgcctgttcactctgatggtagtttcttttgctgtgcagaagctctttagattacttagatcccatttgtcaattttggcttttgttgccattgcttttggtgtgttagacatgaagtccttgcccatgcctatgtactgaatggtattgcctatgttttcttctagggtttttatggttttaggtctaacatgtaagtctttaatccatcttgaattgatttttatataaggtgtaaggaagggatccagtttcagctttctacatatggctagccagttttcccagcaccattgattaaatagggaatcctttccccatttcttgtttttgtcaggtttgtcaaagatcagatatttgtagatatgcggcattatttctgagggctctgttctgttccattggtctatatatctgtttgtgcaccagtaccatgctgttttggttactgtagccttgtagtatagtttgaagtcaggtagcatgatgcctccagctttgttcttttggcttaggactgacttggtgatgcaggctcttttttggttccatatgaactttaaagtagtttttcccagttctgtgaagaaagtcattggtagcttgatggggatggcattgaatctgtaaattaccttgggcagtatggccattttcacaatattgattcttcctacccatgaacatggaatgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtttgtctgttattggtgtataagaatgcttgtggtttttgtacattgattttgtatcctgagactttgctgaagttgcttatcagcttgaggagattttgggctgagacaatggggttttctagatacacaatcatgtcatctgcaaacagagacaatttgacttcctcttttcctaattgaataccctttattcccttctcctgtctgattgccctggccagaacttccaacactatgttgaataggagtggtgagagagggcatccttgtcttgtgccagttttcaaaaggaatgcttccagtttttgcccattcagtatgatattggctgtgggtttgtcatagatagctcttattattttgagatacgtcccatcaatacctaatttattgagattttttagcatgaagtgctgttgaattttgtcaaaggccttttctgcatctattgagatagtcatgtgctttttgtcattggttctgtttatatgctggattagatttgttgatttgcgtatgtcgaaccagccttgcatcccagggatgaagcccccttgatcatggtggataaactttttgatgtgctgctggattcggtttgccagtattttattgaggatttttgcatcaatgttcatcaaggatattggtctaaaattctcttttttggttgtgtctctgctgggctttggtatcaggatgatgctggcctcataaaatgagttagggaggattccctctttttctattgattggaatagtttcagaaggaatggtatcagctcctctttgtaactctggtagaattcggctgtgaatccatctggtcctggactttttttggttggtaagctattgattattacctcaatttcacagcctgttattggtctattcagagattcaacttcttcctggtttagtcttgggagggtgtatgtgtcaaggaatttatccatttcttctagattttctagtttatttgcatagaggtatttatagtatcctctgatggtagtttgtattcctgtgggatcagtgttgatatcccctttatcattttttattgggtctatttgattcttctctcttttcttctttattagtcttgctagcagtctatcaatcaattttgttgctctcttcaaaaaaccagctcctggattcattaatcttttgaagggttttttgtgtctctatttccttcagttctgctctgatcttagttatttcttgccttctgctagcttttgaatgtgtttgatcttgcttttctagttcttttaattgtgatgttagggtgtcaattttagatctttcttgctttctcttgtgggcatttagtgctataaatttccctctgcacactgctttgaatgtgtcccagagattctggtatattgtgtctttgttctcattggtttcaaagaacatctttatttctgccttcatttcattatttacccagtagtcattcaggagccggttgttcattttccatgtagttgagcagttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgcatattttgttgatttggggtggagatttctgtaggtgtctatcaggtcagctttgtgcagagctgagttcaattcttgggtatctttgttaactttctctcgttgatctgtctaatgttgacagtgggatgttaaagtctcccattattattgtgtggagtctaagtctctttgttggtcgctaaggacttgctttatgaatctgggtgctcctgtattgggtgtatatatatttaggatagttagctcttcttgttgaattgatccctttaccattatgtaatggcctttttttgttttccatttgcttggtagattttcctccatccctttattttgagcctatgtgtgtctctgcatgtgagatgggtttcctgaatacagcacactgatgggtcttgacgctatccaatttgccagtctgagtcttttaattggagaatttagcccatttacatttaaagttaatattattttgtgtgaatttgatcctgtcattatgatgttagctggttattttgctcgatatttgatgcagtttcttcctagccttgatggtctttgcaatttggcatgtttttgcaatggctggtactggttgttcctttccatgtttagtgcttccttcaggagctcttttagggcaggcctggtggtgacaaaatctctcagcattagcttgtctgtagaggatattatttctccttcacttatgaagcttagtttggctggatatgaaattctgggatgaaaattcttttctttaaaaatgttgaatattggtctccactctcttctggcttgtagagtttctgctgagagatcaggtgttagtctgatgggcttccctttgtgggtaacctgacctttctctctggctgcgcttaacattttttccttcatttccactttggtgaatctgacaattatgtgtcttttagttgctattcttgaggagtatctttgtggtgttctctgtatatcctgagtttgaatgttggcctgctttgctagattggggaagttctcctagatagtatcctgcagagtgttttccaacttggttccaatctccccgtcactttcaggtacaccaatcagacgtagatttggtcttttcacatagtcccatatttcttggaggctttgttcatttctttttattcttttttctctaaacttctcttctcccttcatttcattcatttcatcttccatcactgataccctttcttccagttgatcgcatcggctactgaggcttctgcattcgtcacgtagctctcgtgccttggttttcagctccatcatgtcctttaaggacttctctgcattggttattctagttatccatttgtctaattttttttcaaagctttgaacttctttgccattggtttgaatttctcctgtagcttggagtagtttgattgtctgaagccttcttctctcaactcctctaagtcattctccatccagctgtgttccgttgctggtgaggagctgtgttcctttggaggaggagaggtgctctgctttttagagtttccagtttttctgctcttttttttttttcccatctttgtggttttatccacctttgatctttgatgatggtgacgtacagatgggtttttgatgtggatgtcctttctgtttgttagttttccttctaacagacaggaccctcagctgcaggtctgttggagtttgcctagaggtccactgcagaccctgtttgcctgggtatcagcagcagtggctgcagaacagcggatattggtgaaccgcagatgctgctgtctgatcgttcctgtggaagttttgtctcagaggagtaccaggccatgtgaggtgttagtccagccctactggagggtgcctcccatttaggctactcgggggtcagggagccacttaaggaggcagtctgcccattctcagatctcaagctgcatgctgggagcaccactactctcttcaaagctgtcagagagggacatttaagtctgcagaggttactgctgtctttttgtttgtctgtgccctacaccaagaggtggagcctacagaggcaggcaggcctccttgagctgtggtgggctctgcccagttcgagcttcctgtctgctttgtttacctaatcatacaactaactcagcaatggcaggtgcccctcccccagcctcgctgccaccttgcagtttgatctcggactgctgtgctagcaatgagcaagactccatgggcgtaggaccctcctagccatgtgcgggatataatctcctggtgtgccattttttaagcccattggaaaagcgaaatattagggtgggagtgacccgattttccaggtgctgcctgtcactgctttctttgactaggaaagggaattcccttaccccttgcacttcccgggtgaggttatgcctcgccctgctttggctcgtgcacggtgcgctgcacccactgtcttgcacctactgtctggcactccccagtgagatgaacccggtacctcagttggaaatgtagaaatcacccgtcttctgcgttgctcacgctgggcgaacttatccttttttatggcggcatagtattccatggtgtatatgtgccatattttctttatccagtctatcattgatgggcatttgggttggttccaagactttgctattgtgaacagtgctgcaataaacatacgtgtgcatgtgtctttatagtagaatgatttataatcctttgggtatatacccagtaatgggattgctgggtcaaatggaatttctggttctagatctttgaggaattgccacactgtcttctacaaaggttgaactaatttatattcccaccaacagtgtgaaagcattcctatttctccacatcctctccagcaactgttgtttcctgactttttaatgatcaccgaactacaaaccactgctcaaggaaataagagaagacacaaacggaaaaacattccatgctcatggataggaagaatcagtatcttgaaaatggccatactgcccaaagtaatttatagattcaatgctatccccatcaactaccattgactttcttcacagaattagaaaaaactattttaaatttcatatgggaccaaaaaggagcccatatctccaagacaatcctaagctaaaagaacaaagccggaggcatcaggctgcttgacttcaaattatactgcaaggctatagtaaccaaaacaccatggtactggtaccaaaacagatatacaaaccaatgcaacagaacagaggcctcagaaataacaccacacatctacaaccatctgatctttgacaaacctgacaaaaacaatcaatggggaaaggattccctatttaataaatggtgctgggaaaactggctagccatatgcagaaaactgaaactggatcccttccttacaccttatacaaaaattaattcaagatggattaaagaattaaacataagaccgaaaaccataaaaaccctagaagaaaacctaggcaacaccattcaggatgtagacatgagaaaagacttcatgattaaaacaccaaaagcaatggcaacaaaagccaaaattgacaaatgggatctaaattaaactaaagagcttctgcacagcaaaagaaactaccatgagtgaacaggcaacttatagaatgggagaatttttttgcaatgtatccatctgacaaagggctaatatccagaatctacaaagaatttaaacaaatttacaagaaaaaaaacaccaccatcaaaaagtgggcaaaggatatgaagagacacttctcaaaacaagacagttatgtggccaacaaacatatgaaagaaagctcatcatcactggtcattagagagataataattcttttttttttctttttattattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgtggtgtttggcttttttttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaactgttcctatttctccacatcctctccagcacctgttgtttcctgactttttaatgattgccattctaactggtgtgagatagtatctcattgtggttttgatttgcatttctctgatggccagtgatgatgaacattttttcatgtgttttttggctgcataaatgtcttcttttgagaagtgtctgttcatgtccttcacccacttttcgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtctttggttgccatggcttttggtgttttagacatgaagtccttgcccatgcctatgtactgaatggtaatgcctaggttttcttctagggtttttatggttttaggtcgtacgtttaagtctttaatccatcttgaattaatttttgtataaggtgtaaggaagggatccagtttcagctttctacatatggctagccagttttcccagcaccattgattaaatagggaatcctttccccatttcttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcagtggtagttggatggggatggcattgaatctgtaaattaccttgggcagtatggccattttcacaatattgattcttcctatccatgagcatggactgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctccggcctaattgccctgtccagaacttccaacactatgttgaataggagtgttgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttggcttcatccctgggatgcaaggctggttcaatatacgcaaatcaataaatgtaatccagcatataaacagagccaaggacaaaaaccacatgattatctcaagagataataattcttaattagacttagcaaatcatacttatcttttgtaacagatatgcggtattgttaagcatgtttttgtttcttttagtccatatcattgcctatgcattattcattttgtgcccctagaaattagcatagtttttgagttttgaattttgaaggtatcttttgacttttgaaggtatctgattttcagactcagtttatgaacatttgaattgcaggaagcattatgtatttatttttatcttaccagtgtttagtgttattatgctcataataagaattcaaaaatattatttaaaataaataaaacaaaaatacttttaaatattttatatttaaattaaaataatctttattgctcttagtttttgtctctagcaggctggatgtttggaaagaatagctatttgagccatgtgataatataggcttaagaaagaaatacagttgtttttgtgtacttaatctattgtatacttagattgaacatatagagaatattgacttcaaatatacattttagatgatatttaatgccatgggaatgaatgaaattactcagagaatagagagtgagaagtggtctagattaagccccaaataagtcagacattttgaagtcagtcagatagagacaaagggctggaaaggatatcaggaacaagcagtgtttggcaagaaaactgctataacgtggtcagaaacatcactacagggttttcctctcctttaggagggattgccagtcctgtagaatgttgctcaaagttttagtaagataagaaatgatcgtttccatggagactagtggttgaactgaaccagagtacctgtggtggaattgtgcagtcaaaatctaaatggaaaggtttaaagtgtgaatgaaatattattggatacatacctaaaagaaaataaatcattctatcaaaatgacacacgcactcatatgttcgttaccacgctattcacaatagcaaaggcatgggattaacctaggtgctcatcgataatagattggataaagaaaatgtggttcatatacaccatgggaaactacatagccataaaagtataaaatcatgtcctttgcagcaacatggatgcagctggaggccataatcctcaatgaattaaaaccgaaatagaaaacgagataccacttgttctcacttataagtggaagctaaacattaagcacgcatggacataaaagtaggaacaatagatactgtagactactagaggcaggagaaaggggagcataggtggaaaaactacctattgggtcctgtgctcactacctgggtgatagaatccagaccccaaatctcagcatcacactatatacccatgaaacaaatttgcacatgtaccccgtgaatctgaaataaaaaaagaattatggatgttttcattggttataatggagggacatagattggaagctgggtggaggatcaaaagataattttctaaaattaaacatactgaaaggtgtttgaatgctattggaataagcctataggtcgccaagtacaaccgaaggcttatgctttctaacagagtatgagcaaatggattctgcaaactttggggaggtggacatttcttcattgtaataaaaaggtatgattgtagagagtatatcaaatggatttgtaagtaagttacatggtcagaaatctaatttcatctattgtctcctagtttcttaataactagtgctcagtgtgcctacaaacaaggtagcacatagaacattctgaataaatatttgtaaaatcaataaattaatagagcctgaggcaatgtcattagctaaatagatgaggaattaatttgattagaaaacagtgtattcttccctaaatcatacatatttcatataaaattgaaagtgctcagaaattgggctgcctctagggtggccaaaaatatgaagtgtgtaatagggaactacacagtgtaatgaatatcatagcacaggcttcattatgctgtggaattattagtgataagctactaatagaaaaagatagatatttgttggccttattcactgcattctatttcaacagtggccacaaaattatttccatacacaaatgtttttgtaggatgtaatattgtgttagtgtgatttatttacaccctaaagcaaatataattcaaaatatatgttatagaagctcttgctgtcttccctcaatatcagcaatgcaaaaagaaagaaactgctttttattataagaaataactcaaaaaggagcaacataaaagtacatttggtcttttatttttatgttttattttgtttataattaacagataatggttgtacattatttgtggggtagtgtgtttcaatacatatataatgaaatgatcaaatcagggtaaacagaatacttatctcaaacatttgtcatttctttgtagtgagaacattcaaaatcctttcttttagctattttgaagtgtacaatacattattgttgactatagacaacctactgtgtaatagaacatggtaacttattcttcctatcgaactgtaaatttgtacctggtgaccaacctctccccatcccctctcctgccactctcctcagcctctggtaaccactattctactagtgattagtgagaagtaaccactcacttcttctataaggtaaactttgttagattctacatatgactgaaatcttgtggtgtttgttcctctgtggttggcttaacataatgtcctctaggttcatggaaactgttacaaatcataaaaaataattttttatgactaactagcattgtattgcgtatataaccatattttctttaaccatgcatctcttggtggacacttaggttgattccacttcttggctattgtgattagtgctgcaataaatataggagtgcaggtatctcttcaacatgctaatttcattgcttttgagtatgtaccttgtaatggaattgctggactatgtggtagttctgtttttaattttttgaggaacttccatgttattatccataaaggctgtactagtttacagtttgtccctccaatagtgtataagagttctttttcctgtgcacctttgccagcatttgttattttttgtctttttcataatagccattctaactgggatgagattatatctcattgtgattctaatttgtgtttctctaataattagtgatgttgagcattgtttttcatatacctgttagtcctttgtatgtcttcttttgggaaatgtctactcagatcctttatccatttttaaattttattattactattatttttgctattgagttgtttgagttccttatatagtctggatattaactacttgtcagaggcatagtttgcaaatattttctccaattctgtagattgtcccttcactctgttgattatttcctttgctgtacaaaagctttttagtttgtcatcatcttatttgcctatttttgcttttatttctcttgcttttgaggtcttattcaaaatatccttgtccagatcaatgtcataaagcatttccccataaatttgtctagtagtttcatagttttgggtcttacatttatatctttaatccattttgagttgatttttgtaagtgttgaaaaacagaggtctagttccatccatctgcatatgcataaccagttttcctagccccatttaggggcttgtcctttccccaatgtgtgttcttggtgcatttgttaaaaatcagtcgggtgtaaagtgtggatttatttctgggttctctaatctgttccatcggtatatgtgtctgtttttaggctagtatcatgctgctttcactatttttgtttttagtatattttaaggtcgggtagtgtaatgcctccagctttgtcctttttgttcaagcttgctttagctattcagggtcttttataatttcatgaaaattttaggattgtttttcctatttctgtgaacactttcattggtattctgatagggattgaattgaatttgtaaattgttttgggtagtatggatattttagcaatattaattcttccagtccaagaagatgggatatttttccacttattagtgtcctctttagttgcttttgttaatgtttcatagtttttattgtagagatcttccatctcctcggttaagtttagtcctagttactttatttttttgtagctattgtaagtgggattgatttcttaatttcttttttagagagtttgctgttggtgataattaataactaattaacaccttaaagagcaaaagtaaggtacacacagttgcctcctaaggcagagggggagtaaaatttgttggagaccttttatgtgcaaggctctgtgccacatgcattacctcttttgaactaatgcaatctgtacatattggaggtgccagctaattatgtttcaattatagttaaactgtctagtagacaagcatttccttttttttaacacagacatggcatcaagaagtagaggagaatgattctggagcaaaaggccaataaaaaagtttacttttttgcccctctaaaagctacattcttcttgtgaacatccacacctcagtaagtgtcatcatcatctatctgactgccagagacagacacttataagtcatggttgtttctttggttttcctcattttcactgccccattcaatcacttggcaaatcctattgaccaagacatcaaaataagtcttatatcttttaatatcttgtcatctctactactataacctctgagaaagcattgttgtctctctcctaaacaaatgcgataaccatctaattggcctctgcttccaaatagcagatacagtaactttttaaaaaatgtaaaatagattaccctctacttaaaataattttcttattgtatctgaaataaaactgaacattcaaagcttctgttatattttgctgccgtgttctccagtctcacccattacatactcccattggttctttatgccccaacatcctgacttctttctgatccttaaaaacatcaataattttcctacttcaggcattgcttatgttgtctttcttgcctggagtgctcttctcctaattctttgtgtgctttatttgttcttattgataagaactcagctagaatatcactccaacagtcatttcctaccaccctagttgaaaacaactccgattgcaattattctctttcatggcttatttccttcagcttttccagtgtaatttgttactctcttgtttatttaggggttatctttgccctgcttaaatgcaaatcccatgaagttcttttttttttttcttgtggttattttttgagacagcctcgctctgtcacccaggctggagtgcagtggcttgctcttggctcactgcaacctccgcctggttcaagtgattcttgtgccttagccttctgagtacctgggactacaggtgtgcaccaccacaccagctaatttttgtgttttttagtagagattgggatctcgccatgttggccaggttggtctcaaactcctgacctcaggtgatctgcccaccttggcctcccaaagtgctgggattacaggcgtgagccacagagcctggcctgggaagctgtgttttgcatttctctctctctccagtgcttagaagaatacccagagcacatgataaccctcttttaaataaatgaataaatgaatatataaatagatgaatggtacaaagtgaaagattggtattctcatacatggtttggagttgtgatgccctagataaaaaacagcttaaacatcatatgggcttctgagagagtgttataaagtttccctttagagtctctttctatattgcaaatctaattaataatatacggatagttttgtaatgtgcaaaaatggtcaatatactagttatattttagctgtcgtatatagtgctggtgaaaataagtctttgtataggcaaagtgcttactttttagtataataacataggcgttgtgattaaaaagaaggactaagagccaggtgataagaattctagtcccaaccttgctagtaaatatctgtgtgataaagcctcagctttctcacatacctataaaatgaggctaacctcataaggttgtgtgaaaattatttaaaataatgcttttaagcattacttagggaaaactgccatcttgctcactgcaacctctgccttccaggttcaagcgattctcctgcctcaacttcccgagtagctgggattacaggtgtgcgctaccacgcccggctaattttttttttttttgtactattggtggagacggggtttcactatattggccaggctggtcttgatctcctgaccttgtgatctgcccaccttggcctccccaagtgctgggattataggcatgagccaccgtgcaagactaatattgtattttaatagctggtaataaaatgaaaattgtcttagcttagactgtcataacaacatatagattgggtggcttaaacaacagacatttattttctcacagttctttaggctgagagtctaagatcagggtgccagcatggttacattttggtgaaggcttccttcctggcttgtaggtggctaccacctcactatgtgctcacattacctctttttttttggtacaggaggagagggagtggagaaggggagaaagagagagaaagagtgaggcagagacagaaagagaatgaatgagtgagaactctggcatctcctcttatagggatactcattctattgtataaggatcccatttttatgtccttatttaactttacctccttatagacctcatttacacacacggttataatgggtgttatggctttaacatatgaattttggtgatgtacaatttagtccttagcaaaaataaatttaagatatattctcaaatgttcatttatgaatgtttagttctattactttctagactttccctttgagttctaattttccagtacaactaaaacaaatatcaagaacaagacatttagtctttttctttctctctctggtaatcatcataatagttttttaataggaaagctattcaaggaatatctatcatcttgttattttgtggaaatatgctatgttggagaagtagtaaagccaaaaaactgacagatttttttttccttgatattctaaggtctaggttttattaacttggttccatttagtgttgaggcaaaggctttaaatgaatcattaaatggttgagcagtggtatatgtttaagctcatgctcttcatggaatggttacagtcaaacctttcagtcttcattgcacagtagtgtactgcagtgctaagagcattaaagttacaaaatttgatttaaatctagactacgttagtatattggatatagtaagaatattgatgttcagaaagattaagtaatttgcccaaggacacaatagtcttattagtgaagaagagatgagaacactcatcactcaggggattatgaagactaaatgaaaatgtgaatgccaaactcaacatactctgggcttgatattcattcaatattcaatattcagtaagatattcatttttacttcattttcatgatcttgctaatttataatcatattttaaatcattagcactataacctaagttgattatgaatgtgttttttttttttttttttttttttttttgagacagagtcttgctctgtcacccagtctggagtgcagtggcgcgatctccgctcactgcaagctccgcctcccaggttcatgccattctcctgcctcagcctcctgagtaactgggactacaggcgcccgccatcacgcctggctaatttttttgtattttttagtagagacagggtttcactgtgttagccaggatggtctcgatctcctgacctcgtgatccgcccacctcggcctcccaaagtgctgggattacaggcgtgagccaccgcgcccgtcctatgaatgtatttgtaaaggcaagagaagaccatggtcgtgagctgagggaccatgggtaacatgaagaccgagtactggagggccaaatacttctgtcaaatttcataatagcaagtatgcagctagtaggagttaaagcagttaaaacagctcttccttttaccatatttcctgctatcgtgtgtgtgtgtgtgtgtgtgtgagagagagagagagagagagagagagagagagggaaatgggtttgttttgggaagtggcatcagattcatgtttctcattgcaacttaaaaaatagcaagcctaattgttggatagttataatggctttactacttctccaacatagcatatttccacaaaataacaagatgatagatattccttgaatagctttcctattaaaaaactattgtgatgattaccagagaaagaaaaagactaaatgtcttgttcttgatatttgttttagttgtactggaaaattagaaaaataaaacttaataaaatatgtttcacaatgaaaagacaatatatgttcttaaacagtaaaaaagtacacagactctaatggcaatttaattcttaactgtaatatatagagcataaaattaaccaaggcatgaaatctcggtatatttttttgtttgtatttaagatttcaatttgtactggctcataaatttcatctgagataaaggaaaacagcttgtctatatatctactcctttagatcataaatattttctgagaaagagtaatatcctctgctttgacaattccggaaatacattttataacagtgcattcaaatgtttcccataatatgtcagaaaaactgcagatgttgtggaaaattcaatgttatggattcatacaggtcagtaatgtcagaaattcatgacctgtgctagaggaaactcctagacaggatagtgaagaatgcaaagttttaagtgaaacattaatacaagtttgtgggttactacacagcacagaacagacaaccaaagaaaaaaagacaggacatattattataaagatgtttccaatataagaattttagggattctggctcccaataatggcagagtacatacgtgtatgtgtgtgtgtgtgtgtttgtgtatcacaaatgtacagagcatatacataaataacatatggagtatatagtatatatagtattgtacaatgtaaagagtagcatgtatatttatctctctatagacacacacatatacattatacttgtgcatatatatgtatgcatgtatttgtatgtatacatttgagtcccaccaaactagagaaaaatcctcagtaaaaactgttttcagtagaaaccctaattttcccaggtgtatgcttaaatgctatgcctaaaattaaaagattaaaagattatcctaaaaccaagggcaaaactaaaatagatttccctaacaaaatataaaaccaaatctcagccaggcgcagtggctcacgcctgtaatttcagaccttcgggaggtcaaggcagataggtctcttgagcctaggagtttgagaccagcctgagcaacatagtacaaccctgtctctaccaaaaaatacaaaaattagcggggcatggtggcatgtgcttgtagtcccagctactcaggaggctgaggtgggcatgtcgattaagcccaggaggtccaggttgcagtgagccatgatcaggccactgcactatcacctggtaaacagagcaagaccttatttcaaaataatattaaatttaaaagaattaaaaaacccagacctccacaaatctgagatgacccaccagtaattttaactgacttacaggagaaagcatagaatttttcagatgaagatatgatccagactcttaatatgctacttcacaatgttcactaagcaacaaaaaattatgagacatgtgaataaatagaaaaatgtaatccatagtcaagaaacaaaatgagcaaatatatttcacaattagcagggaagacctttaaataagtacgataaacatattaaggtatctacagaaaaagttagttataatgagttaaaaaatcgagaatttcaggagagatataaaaagtatttaaagaaagagagaagcaaatgcaaatcttagaataatatcttaaatcaatacaaaacatttcattttaatcatgattatgtaaatacttgataaaaagtacttgataatacttgattcattttgttactatctcaaatctttttccaagactatagctctagaataaaacatttgttttcatcattactagaagaaaaaaattaattttgggggacttctaagcaaaatctttctattgttaagttcccattaattgctgctgtttctggtcagagtctattctttttagcaactcataaacataagaattggtgtatgctgcctcatcaaaagtggaaaccagacttggaatatcaaaatgattcattatcgtttaatgtttatttgagtcataaatattagaagatcataattcatttgagtcatggtttaagaaaaacaagcaagaaaatgtatagcaaactgatttattttgaaatattctaccctccatattaaatgtaaactttcatatataatgattattttttaagtaatgacttaaatagaggaatgaacttaactagtatcattttgaaagaatatgtgtttatcaggcacctgggggaaggtaattaggagagaaaaaaatatcaccagatgtcatgatgcttgtagatagagaaaataaaattgatgggagaaaaatcataaaatatcctaaaaattcagtgtctatgagtttaggaaaaatattttttcactggcttttagtcatcctttgagggcatttgtcatcagaaaaaataattctatttgtgtttttgttgcaattgctttggggaacttagccataaattctttgccaaggtcgatgttgagaagagtacttcctagattgtcttccacgatgtttataatttgaggtcctacattgaaagctttaatccattttaagttaatttttgtatatggtgaaaggtaggagtccagcttcaatcttctgcatatggctagctagttatcctagcaccatttgttgaatagggaatcctttctctgtggcttgtttttgtcagtcttgacaaagttcagatggttggttgtaggtgtgtggcttatttctgagttttctgttctcttccattggtctaggtgtctgcttttgtaccagtgccaaactgttttggttactgtggctttatagcatagtttgaagtcgggtggtatgatgcctctggatttgttctttttgcttaggattgctttggtgacttgggctttttttttttttttttttttttttttgttccatatgaattttagactagtttttctagttctgtgaggaatgacaggtagtttgataggaatagcactgaatctgtaaattgctttgggaagtgtgaccatttttacgatattgaattcctccaatccatgagcatgagatgctttttatttatttgtgtcctctctgatttctttcagcagtgttttgtagttctccttgtaaagatcttccacctccttggtcagttgtatttgtaggcattttatttttttgtggctattgtaagtgagatggtgcttttgatttatctctcagcctggaatgctggtatatagaaatgctattgatttttgtacgttgattttgtatcctgaaattttactaaagttgtttatcaattctaggagccttttggcagagtctttaggatatttcacgtagagaataatgccatctgcaaagagagatagtttgacttcttttcctatttggatgcttttcatttctttctctgaaagttgctgaaagtgtttatcaattttaggagtctttgagcagagactatagggttttctaggtatacaatcatatcatctgtgaagagagatagcgtgacttcctattttttttttgacggagtctcactctgtcacccaggctggagttcagtggcacgatctcaactcactgcaagctctgcctccagggttcaagcaattctcctgccccagcctcctgagtagctgggattgcagacacctgccaccacgcctggctaatttttgtatttttagtagagacagggtttcaccatgttggccaggctggtcttgaactcctgacctcaagtgatctgcccacctcagcctcccaaattgctgagattacaggcatgagccactgcacctggccactatttagatggcttttatttccttcttttgcctgactgctctggctgagacttccagtactatgttgaataggagtggtgagagtcggcatccttgtcttgtttcaggtctcaaggagaatggtttgagcttttgcccattcaatatgatgttggttgtgggtccgttacagatggctcttattattttgaggtgtattcctttgaactctagtatgttgagggtttttatcatgaagaaattttggatttttatcaaaaggtttttctgcatttattgacatgacaatatgatttgtgctattgattctggttgtgtggtgaatcacaattatcaacttgcagatattgaaacagccctgtattccaggaatgtctccaaagtaacaaaaacttgctaagttgataagtgggacctaattaaaataaagagtttctgcacagcaaacaaaaactatcaacagagcaaacagacaacctacagaatggaggatattcacaaactatgtacctgacaaatgtctgatatctggaatctatagggaacttaaatcaacaagcaaaaaaaaaaaccttattttaaaaatgggcaaagaacatgaacagacatttttcaaaacaagacatacaagtggccaacaaacatataaaaaatgctcagcatcactagttgtcagagaaatgcaaattaaagccacaatgagatatcatcttacaccagtcagaatggcttttattaaacagtcaaaaagcaacagatgctggtgaggttgtggagaaaagggaacactgttggggggcttaaacactattggtaggaacataaattagcatgaccgctatggaaatcagtccagagatttctcaaagaacttaaaatagagctgctattcaacccagcattcccattactgggtacaccaaagaaaataaatcattctacctaaaagacacatacgttcatcactgcatattcattcacaatagcaaagacatgtgatcaaccctggtacccattaatgatagagtacaatttaaaaaatgcccatatacaccttgaaatactatgcagccataaaaaagagggaaatcatgtcctttgcagggacatggatgatcccggaggtcgttatcctaaacaaactaatgcaggaatagaaaaccaaataccacatgttcttgcatataagtaggagctaaacattgagcacacatggacataaatatgggaacaatacacatcgtggactactggagggtgggggtggatttaaaaaactacccattgagcactatgctcacacctgggggatgtggattcatactccagacatcaacttcacacaatattcctatacaacaaatctacacatgtacttgtctctaaaataaaagttaaattttaaaaaataaagattccaaggaaacagattcattcattaatcttataagcatttataccattcttgaattatgtaccttgtgagttgttgaatatctaatgctaaggcatagaccctgctcttcagtttggtaaaatttcttggaacagatagctaaacaaaagaacattacttatataatgttgtatgccacatgctagagttttccatgtggtattgtggaagctcaatgtgaaacactgaggaagtggagatattgaagagtccttctagaagaatagctgtctgtgatgagagcaattgaaaagcagtgggggaaagcagggacgagtcttctgatcacagaaaataaggtaaccaaaactcatgcctccttctagtattacgaatagtttcgctgagtgggatgtaccatgtactacaaggtatgctgatgaagaagctgggagataaggatggagatgagaatagagggccaatatgtgtttacaggtcagagaaaccattaaagaattttaataagggtattcataaattcagattttagatactttgaagacagtttagaatggacttcatttgagtggaatataagataggcaggaggctttttataaattcagacaaagaattaggtagttctaaacaagaatggagaaaaggcttaggaaagaagaaaataactatatgagtacatttagagttaatttgaaggtccttgtcattcattgaacattgattaaggaaagggaaaagttatagattatttccagattttttgtctggaccactgtacagatattaagaatattctataaaatggaaacaggcatttcagagcaaaaattattatttagtttttaccagcttactttgaagcgtctactacacataggtttggagtgagaggtggttaataaaattttaatctcaagctcagggcctaaacctagagaaatctagatatgggcataatacaaatgtagatttgaaagtaatttttaagggtgttgatatcctgggagatgagattatccaaatgagatcctaaatgaaagtataaaaatataaagaatgggactttgggtaaagagtagcatttaagtggttgttagaagaagaaaagccaaaaaagtctactgaagaggaatggtctgcagagagaaaggacaccaatgccatggacagggagacttctcgaagggggagtgatcaaagggtgtctgttccttcagtctagccaaggactgaatacatccaatgaatttaggaacaaagaagtcaaaggtaactttggcaagggtggtttcagtggaatggtgtgttggaagccacagcgaattaatcaaaggtgtaaaagattgataagagaagcaggcaaagagatgtgagcatacttacattttgaagagagaacatggtgaagtaaaataggtcatggttcagaagacagatggtttcattgacggaggactactcttgagaaggaagtgccaaggatacagaatattggtaatgagtggatgaaggacatgaaaagatagaaatcagtgaaaggccaggcacggtggctcacgcctgcaatcccagcagtttgggaggctgaggcaggcggatcacaaggtcaggagatcgagaccatcctggctaacacagtgaaaccccgtctctactaaaaatacaaaattagccaggcgtggcagcgtgtgcctgtagtcccagctgctggggaggctgaggcaggagaatggcgtgaacccgggaagcggagcttgcagtgagccgagaggcttgatgaggtgttcagagtgagtctagccaaaaatatgtggccaattgaacctccaacccccacataaaaaagaatccaaaattcaatactaggaattattcaggtaccagagaagaactgcattgctgtggagttatggagctcagtagcaagcagctatcagacccagaggagactaatgtcaaggtggttggataagggcattcacccaattttaagaaactacacttccaaaaataaaataaaatgcatgttaaagttctactcaaaatgaatcagagggcaaaatttaaaagatgaaaatgccacgaggtcatttcctggatctacctgtcctccaactggagtatacctacctaatgtatttaaaataatgtacaaatttaaataacaaagtctttaaaatatatatttatcttaaatcctcctcttcacaggaggatttaagatacattattttaaatattgtattatttaaatcttcctgtgaagaagatttaaaataaatacattaatgctttatacatgtatttaaaatttatacaaataaaactataaacttttttccactcaactattgtaatctggtactttagttggatcaaaatatatttgcaaagctatatatttcagagagaagagaatctgatttatgctgctaaatcatgcaaagatagacaccctgggatttttctctatttttttttaattaacaacttcatatgctggaaaatagttttctgcttattttatggcaaaatttattttggcttgtaatcatagactataacagccatgtttgtgccatataaaaatttgataacatgactatagcaaaacgtatctgaactatatgtcccattttaggttatgagacttaaggagggtgtgggttaaatcctttatttttgaatcacttgcccaagactgcctaaatcctaggcagtcttataggaagaccagagagcaatagaaactgaattttaaggcatagggtctcccattcaatgtattacaagtgatccctaaataaatgtaagttgatttacttattgcctcacagtactggattcagaggtctctatgcatagtccttcttgcaaaaatttcttgcttggtaatgaaattttctaggagatgctccaggaaatctcacagctagaaggtagactcgttttcggatgatggagacctggcttatattctgaataatgtaaataaaacagtgacttctagttctccagggtattttgttttaaagtaaaacacactaccttgttcaatctaggttaactgtggcatatcaacctttcactatcactcatcagtttttaatttctaatgagaaactttatatgaagagaattatttcatacttgattgtctgccttttaatccacacgggtaacatttgaaggacccgttgcttattctaattaatatttgagttcctattccctttaggtatgcaattactgttttctgtgttgttctcatgtcttttatgatgctgtttttctttgcagatttagtatacaaagcatgtatgttcctttagggtgttagcaaaaataattttccttgtctgggcttagatggtgcagcaagaggctttagaaattcctgttgcagagatttatataagactgccacatcttactggagaatgatgaaataatgaagcagaaataatctgaagataatacctgagaatcaaaagggataaagtaatcacagtgcattattccactagttctaaatgttttcaaataaaaaaagattaaagacaggcttgagaggcatacaaatgatttcgacaaagccataaatttgaaaatatgctgagtaaagtatataggtgtatagaaaatcatagcactttggaatttacaacttaagcaaagtagtagaagaaagtctccccgaaatctttgttgaaatgaaatacaaatgaaaatagtattagaaagaaatctgaagagatttacagcatgtaattggaattacagaaataaagcatttgtgtaacatggtttgtaagacaaaacattatttttctatttgtaattcccttttgacttgaaggagagtgaaatgtgggtacatggagaatattttgttttttctgaatagggtaacagatgtgggtaggtatttggaagtttggaatcatttgaattataggaagagggctacagtttgaattgtcagaacaattctaaatttgtctttaaaaagtgtgggtgaatggtctttctggatcagagaaatggatcaagggggagcagcaagacagggaaaggtagagagggagaagaaaagagagaaggagattaaaaaagagagaaacacgcaattgcctcagaactgacttcagaagaaatgttgaaaggaattttatgccgtgagagacaaattatccttttggactcatctacaaaatcctcagtaaatttacatttttcattaaggacatatgaaaaaattaaaaaagttatatacatggaggctgctaaaatctggtttacataggcaatgataaatgaaaacaatattactgggaattgaatggtataaaacgtgtaaggactatgagacatttacagagtgctctcttggtgggaagtaggtgttgtgctaggcacattaaaaacttggtcccttgttacaaagattatgtacaaatgaaaaggtgaaataattttgaaatgaactgtttcctgtaaggcaaggatagacaaaagagaagtagaaatgcaagggaaagtggaaaaaaaactgccaagtagggatgaacaaaaggagtaaaatattcaagtcaggccagcagaaaaatactttcctcaattttctttcagctaaagaataaacgagttagaatgatatgggagtagggggtggggggttgtaattctacctttatttagtagcactctcacttgccatgaaacctgtatcttcatattagagcagaattcatccttggtgccaggaagctcccggaatctatgaggtgacttggatcaaagagatcaatatctaaagactttaaataacctctgtgttatctgctgaactatgtcctcctaaaatttttttgttgaagtcctaacccccagtaccttacactgtgacagaatttgaagatagggcctttaaagaggcaattcaggtaaaatgagatcatacacctggtctgtaatccaaaaataactgtgcttttatcagaagagattaggacacagacctgaagggaaggccacatgaagatcccagagggatggagccttttacaagccaaggagagaggcctcgggaaaaatcaacccagcctacattttgatcttggacttctagcctccaagacagtggaaaaataaatgtctatagtttaagccacccagtctgtgatactttgttatggcagctctaacaaactatcatttttacctttccctccctatcacctcatcaccctctaaatcatatgggacagatgtgaactgacgtttgtattgttattcaacctaggtagatccatgttgagtcatatacatgtgtaatttacataggtgcttctgtggctgaaattactaatctaatctggtatcttttaccaattacatccatcagagagagcctggtcatatgtcacctctggatcttagctgtcaaccaaaaggacgctaagacaaaaaagcctgtcctttatgtgggcttttattattattgttatttttttttgacgaatttttgtgtttaggaaaaagacgtatagctggtgtaaccagctaagggcctggggcagaatgggaggcttgcaggaatgtgtgtcggttagcaaatatgccatggagatttgcaacacttaagcctgcgtgtagtccttgctattcatcattctgttaactgcacctctctagtaattattttacatggccaggtaatttatatttgatgttgataaatatagtcctacaaaacattgaagtagttttctccggtatgaaagaaagcaggcattgtgtttgttgttgttttcagtatagtttaaggttaagggaatttgtaactttataatgagtaataaatgcatggtataatttctttttactgattagaatttttagtttactgcatactgtatcagtaatctatataatataaagtttccaaaggtccctatgtattgttttaattgtggtggggccgagcgcggtagctcacacccgttatcccagcactttgggagattgaggtgggcggatcacgaggccaggagttggagaccagcctggccaacatagcaaaaccccatctctgtgaaaaataaataaaaaaaaaaaattagctgggcgtggtggcaggcacctgtagtcccagctccttgggaggctgaggcaggagaatcacttgaactcaggaggcggaggttgccgtgagccgagatcatgccattgcattccagcccaagtgacggtgtgagactccgtctcaaaaaaaaaaaaaaaaaaaaaaaaaaaaagtctaggtattaaagttgtgctaattcttccttggtggttcatacctgtaatcccagcactttgagaagccagggtgatggatcacctgaggtcaggagtacgagaccagtctggccaacatggtgaaactgtgtttccattaaaaaaaaaaaaaaaaaaaaaaaaagctgggcatggtggtgtgcacctataatcctagctactcagaaggctgaggcatgagaatcacttgaacctgggcggcagaggtagcagtgagccaagactgctccacggcactccagcctgggcgatagagcaagactcggtcaaaaaaataaataaataaataaatttttaaaaaaagtcttggtaaagggatcaattcatcaagaagagctaactatcctaaatatatatgcacccaatacaggagcacccagattcataaagcaagtccttagagacctacaaagagacttagactgccacacaataataatgggaaactttaacaccccactgtcaatattagacagatcaacaagacagaaggttaacaaggatatccaggacttgaactcagctctccaccaagcggacctaatagacatctgcataactctccacccccatatcaacagaatatacattcttcttagaaccacatcacacttattctaaaactgaccacatgattggaagtaaagcactcctcagcaaacgtaaaagaacagaaatcacaacaaactgtctctcagaccacagtgcaatcaaatcagaactcaggattaagaaactcactcaaaactgcacaacttcatggaaactgaacaacttgctcccgaatgactactgggtaaacaataaaatgaaggcagaaataaaaatgttcgttgaaactaatgagaaaaaagacacaaggtaccagaatctctgggacacatttgaagcagtgtgtagagggaaatttacagcactaaatgcccacaagagaaagcaggaaagacctaaaatcaacaccctaacattacaattaaaagaaccagagaagcaagagcaaacacattcaaaagctagcagaaggcaagaaatcactaagatcagagcagacctgaaggagatagagacacaaaaaacccttcaaaaaatcaatgaatccaggagctggttttttgaaaagatcaacaaaattgatgatagactgctagcaagactaataaagaagaaaagggagaggaatcaaatatacacaataaaaaatgataaaggggatatcaccactgatcccacagaaatacaaactaccatcagagaatactataaacaactctacacaaataaactagaaaatctagaagaaatggataaattcctggacacatacaccctcccaacactaaaccaggaagaagtcaaatctctgaatagaccaataacaggctctgaaattgaggcaataattaatagcccaccaaccaaaaaaatccaggaccagatagattcacagctgaattctaccagaggtacaaggaggagctggtaccattccttgtgaaactattccaatcaatagaaaaagagggaatcctccctaactcattttatgaggcaagcatcatcctgataccaaagcctggcagagataaaaagaattttagatcaatatccctgatgaacatcaatgcaaaaatcctcaataaaatactgacaaactgaatccagcagcacatcaaaaagcttaaccaccacaatcaagtcagcttcatccctgggatgcaaggctggttcaacagacacaaatcaataaatgtaatccatcgtatacacagaaccaatgacaaaaaccacatgattatctcaacagatgcacaaaaggcctttgacaaaattcaacagcccttcatgctaaaaactctcaataaactaggtattgatggaatgtatctcaaaataatcagagctatttatgacaaacccacagccaatatcatactgaatgggcaaaaactggaagcattccctttgaaaactggcacaagacaaggatgccctctctcaacactcctattcaacatagtgttggaagttctggacagggcaatcaggcaggagaaagaaataaagggtattcaattaggaaaagaggaagccaaattgtccctgttttcagatgacatgattgtatatctagaaaaccccattgtctcagcccaaaatctcctcaagctgataagcaacttcagcaaagtctcaggatacaaaatcaatgtgcaaaaatcacaagcattcttatacaccaatagcagacaaacagagatccaaatcatgagtgaactcccattcacaattgctacaaagagaataaaatacctgggaatccaacttacaagggatgtggaggacctcttcaaggagaactacaaaccactgctcaatgaaataaaagagtacacaaacaaatggaagaacattccatgctcatgggtaggaagaattaatatcgtgaaaatggccatactgcccaaggtaatttacagattcaatgccatccccatcaagctaccaatgactttcttcacagaattggaataaactactttatagttcatatggaaccaaaaaagagcccacattgccaagacaatcctaagcaaaacaaaaaaaaaacaaaaaaaaaacaaaaaaaacaacaacaacaacaaaaaaaaacaaagctggaggcatcacgctacttgacttcaaactatactacaaggctaccatagccaaaacagcatggtactggtaccaaaacagagatatagaccaatggtacagaatagagccctcagaaataacaccgcacatctacaaccatctgttctttgacaaacctgacaaaaacaagaaatggagaaaggattccctatttaataaatggtgctggggaaactggctgccctatgaagaaaactgaaactggatcccttccttacaccttatacaaaaattaattcaaatggattaaagacttaaatgttagacctaaaaccataaaaaccctagaataaaacctaggcaataccattcaggacataggcatgggcaaggacttcatgaataaaacaccaaaagcaatggcaacaaaagccaaaattgacaaatgggatctaattaaactaaagagcttctgtacagcaaaagaaactaccatcagagtgaataggcaacttacagagtgtgagaaaatctttgcaatctacctatctaacaaacggctaatatccagaatctacaaagaactcaaatttacaagaataaaacaaccccatcaaaaagtgggcaagggatatgaacagacacttctcaaaagaagacatttatgcagccaacagacacatgaaaaaatgctcatcatcactggtcatcagagaaatgcaaatcacaaccacaatgagataccatctcatggcagttagaatggtgatcgttaaaaagtcaggaaacaacagatgctggaggagatgtggagaaatgggaatgcttttacactgttggtgggagtgtaaattagttcaaccattgtggaagacagtgtggtgattcctcaagtatctagaactagaaaaaccattgacccagccatcccattactgggtatatacccaaaggattataaatcatgctactataaagacacacacacacgtgtgtttatcgtggcactattcacaatagcaaagacttggaaccaacccaaatgtccatcaatgatagactggattaagaaaatgtggcacatatacacatggaatacaatgcagccataaaaagatgagttcatgtcctttgcagggacatggatgaagctggaaaccatcattctcagcaaactatcacaaggaccaaaaaccaaacacggcatgttctcactcataggtgggaattgaacgatgagaacactgggacacagggcagggaacatcacacatgggggcctgtcggggtgtgggtggctggaggagggatagcacttggagaaatacctaatgtaaatgacgagttgatgagtgcagcaaaccaacatgatacatgtatacctgtgtatcaacactgcacgttgcacacatgtaccctagaacttaaagtataataaaaaaatgaataataaatgcatggtatagttcctttttactgattagaatttttggtttactgcatactatatcaataatgtatataataaaaagcttcctatgtattattttacttatggcagagcacataaatatttattaaaatatttagtgagctatggaaactttccagaaaagtttaattcatttagcagtaagatgaataggccttactttcagtcctgagggaattaatatagtcctgaaaacatgaactttgtctggaagattcagattataatctttcctttgtgtgttgggactgagctgagtaccgtgttggaaattaggaagcctaaagtccacaattggctctccctgtttataacaattctgaccttaagcaagtcacatcacatgactgtagattctctcatctataaaatgagaaggtagttgattcacaaaactccatccatctggcattatgctaggcactgagaagacaatggtgagtaaagcactgctcttgatcagtgttctttaatagagcctagaatttgcttgtgataaaatactttcctttttctaaccaagtatcatttcaattcaacctatttttgatttatcttgttctttcctctattttttaagtctaatagctgtgcgagcttattgttacatggggtctaattgtaaactaaagaatcatacatggttattacataatgttattatttactaaagtgaatactccaaatattcacaaatagcctagttaaaactatttaactgtatattaaaaacaactcaatcaagataaaatagggaaacatggacaacatttagaaatgcgcattcgtcttaggagagggaaaagacaataatgtttgtgtgaatttggcttaccagatgagacagaaaacattgaaacaaattctgatagaaatcttgtcattatacatggaaccaacccaaatgcccatcaatgataggctgaataaagaaaatgtggtacctatacctcctggaatactatgcagccacaaagagaaatgagatcatgtcctttgcagggacatggttgaagctggaagccatcatgctcagcaaactaacacaggaacagaaaatcaaacatcacatgatctctttcacttataagagagagttgaatattgagaacacatggacacaggaaggagaacaacatacagcagggtctgttggtgggtggggggtgaggggagggaacttagaggatgggtcaataggtgcagcaaaccaccatggcacacgtatacctaggtaacaaacctgcacgttctgcacatgtatcctgttttttttttttgaagaaataaagaaaaagaaatattgtcattttataaagtgcactgaaagctggatgaaagcttatgaagaaagaataaatcaatacattgaagagcaaagaccaatctatttccagaaaagtgaatctgtacagaaaggcagaagatcattttagcattaaatataaaatctaacagtgccttgtaaatgtagccacaatattcataatcaaagggggcaagataactctaagtgacatggacaacagaactagagggatataatttatagaaggaagaataaatttgttctcttaaaacttacatagtgagtacatattgtaaaaaaaagattaaaaagtgttagtatgatgatattattatattattaattattttcctgacatctttttgtccctcttactgacattaactacaatgcagttcctagaccttagtgttagactgggttccaaactagattcctctgctttctggacacaccctctaagccttagttatatcatcagatagctaactataataataccttttagtgttgatgacactactaaatgagataatgtatgtgactaacaatgcttaaatatgtggtcttattataattaaaagtaatttactaaataaagaaatattgagcatctgaaagaaatgcatgtagattttgtaatcctaagggctaaatgaataaagtaacagagccccatgaggtagcttatttgctgcaaatcaatttattttattattattttaaattttatttttccataagttattggggtacaggtggtatttggttacataagtaaattctttagtggagatttgtgagaccctggtgcacccatcacccaagcagtatacactgcaccctatttgttgtcctgatccctcaaccctcccactcttccccacaagtccccaaagtccactgtaccatttttatgactttgtgtcctcatagcttagctcccacaatcagtgagaacataaaatgtttggttttccattcctgaattatttcacttagaataatagtctctaaccttatccaggtcattgcaatttaaatgagctaatttctattttcagttgaatcgtttaaaaaatagccaggtgttttcctgagcccattgtcttggggtttaattcctccataggtttgttgcatttgttctgttttatgaccacagatattcctaactttagttagttctttttttaaaaaaagcaagtctttcaaaatagaagctgaagaaagtacataaatatgagtcagaaccaatcgacctatcaccatgtgaaataagcacctagaaattcatcttctgctcacaaaaggtcggaagctaaaagattacacatggttataaatacaagctggttatacttctaatgcaaaactaaataggactagaaggcagatggcattaacccttttacttttgagagcacaaaaaccactgcatgaactgttagtcattaattcacttttttcccaaaggatattttattaatctgttattaacagtaacctctaatgaagaggaacaatgatatcaatggaattttctgcattgcttaaaaatctttcttttactgaattagaaataaaaacttcaaatgagataaatgtaaacagaagccaatagttctggcaaaatgatttttctcttctcgtctgacttggcctccaggaggttgggggaatgagattgggaggaagaaacataaacagtgagaagagaaatgtgtgctcatgatacccagtaggtggtgcagctatactagctataattttgctatttaaagggcatgatagaatgctgttctcttcatgaacatttataatcagagtaacagaatgcattgatatgaatctctgttcataaatgaccatcagttgtcatcttcatcagcataaactgtaaagtacctcttgctgcatatgaactatttcaccttgctggattttcctaaagtgaatttaacttcttcaacaattgctggattttcgcacagaaatttgtttctattttctgtcaatagcgtcctcattttcttagcaattaatcttaaaacagaactttttcacttccagtctctcagtatccatagctaatagagttacccaactctggtgattattttaaaaggttttcacatttatccctttccatttcacctttagtttctctagcttcaacttccttatttgcttatgcatctctcaagtaagataacaccttttctatctaatccagagcattgttgggagtgtaaaataaaataatgtgtaggctgtgctacaaaaggttttagagttgggaatttttttaatcaaagattctgagctagtttcagtctccatatagcttgcttgcctcaccatttgatgtgctgggtctgcgcatacaagtatattacctacattatatatgcacacatatatgcatatttatatgagtaatagagacaaaactactacatataaacatgacattgtactataagtatgatttaatactctcagtatcaatgatttatctcccactaaaacatttgcctaaatgtagatcaaagtgcatatattttttctttctgacaactagatagggctaagggttgaagaggaaggaatgaggtggaacaatgactgagattgaagagaaagaatatagcgactggagtcttatcaactgaaagaagaactttcatttttgaggggagaggtctccatgctaaactgaacttaggtgtgcatcttcccacccctacccctgtgcaaaacataacttgcagacaactcagagcctaatcatgaaggattcttctaagccttcccatgcttaatataaagtgggttgctttggtgacttgcttaacgtcaatggtgtgacggaaaactttggctctaaccaaaatcaagtgcacagaacccactaagaattttttgtgagcttagccaactaatatttatgcttgaaatataaacccttttgtaagatttaaataaaatcacttgtgcacaatgcctggtacacattagatgttgagtaaatatttgatgaatctcaatcattgatgtctataattggaagagaatttagaggtagctcttattattttatgaataagttaatgagcctagaaaacaatgatcctaccaacatattactgaatcagtaccagtctagcaaccagcagtcctgaatttcaattctctttccattgtattgtaaacttttcctttcttttgctttgtatcatcactctcctttctaacacagtctctctctctttctccccctccctcgtccttcttcctctctcataggcacacacaaaactttgtgctcatttggcttaagaatccagaatttctcaaaaataaacagctaaatttatgtaggtttactaaatttaacaatgtatttagagttgctttcattgcaataaaaccattaattactctcagtatgctttaggttaattaactaaggagaatttgttaagggagtttatgtattgttttagtatgtagcaaaaggagctgttgaatgctagaaaacaaacccatctgaactaaaaaacacaaaatactatgtattgagcagatatacaatttttaatcaatcaaaacacagattttacctcagtgcatctcactttggtaagtatgtgcagtcccagcttcatgagtttttttctgagaattaatttttaagttgactctggtacttagatgaattttgattgctgatattggaaaatattttcttctcagaaatgatgttatacattttggttggcttaccacacaaaagccttttatctcataatacgtaaataatacaataatacaattcagtggtactggtaacacattcaaaagctagcagaaggcaagaaataactaagatcagagcagaactgaaggaaatagagacacaaaaaacccttcaaaagattaatgaatccaggagctggttttttgaaaagatcaacaaaattgatagaccgctagcaagactaataaagaagaaaagagagaagaatcaaatagacgcaataaaaaatgataaaggggatatcatcaccaatcccacagaaatataaactaccatcagagaatactataaacacctgtatgcaaataaactagaaaatctagaagaaatggataaattcctcgacacatacatcctcccaatactaaaccaggaagaacttgaatctctgaatagaccaataacaggctctgaaattgtggcaataatcaatagcttaccaaccaaaaaaagtccaggaccagatggattcacagccgaattctaccagaggtacaaggaggagctggtaccattccttctgaaactattccaatcaatagcaaaagagggaatcctccctaactcattttatgagtccagcatcatcctgataccaaagccaggcagagacacaaccaaaaaagagaattttagaccaatatccttgatgaacatcgatgcaaaaatcctcaataaaatactggcaaactgaatccagcagcaaatcaaaaagcttatccaccatgatcaagtgggcttcatccctgggatgcaagactggttcaacatacccaaatcaataaatgtaatccagcatataaacagaaccaacgacaaaaaccacgtgattatctcaatagatgcaggaaaggcctttgacaaaattcagcaacccttcatgctaaaaactctcaataaattaggtattgatgggacgtatctcaaaataataagagctatctatgacaaacccacagccaatatcatactgaatgggcaaaaactggaagcattccctttgaaaactggcacaagacaaggatgccctctctcaccactcctattcaacatagtgttggaagttctggccagggcaatcaggcaggagaaggaaataaagggtattcagttaggaaaagaggaagtcaaattgtccctgtttgcagatgacatgaattgtatatctagaaaaccccattgtctcagcccaaaatctccttaagctgataagcaacttcagcagtctcaggatacaaaatcaatgtgcaaaaatcacaagcattcttatacaccaataacagacaaacagagagccaaatcatgagtgaactccctttcacaattgctacaaagagaataaaaaacctagggatccaacttaccagggatgtgaaggacctcttcaaggagaactacaaaccactgctcaatgaaataaaagggggatacaaacaaatggaagaatattccatgctcatgggtaggaagaatcaatatcataaaaaaggccatactgccaaaggtaatttacagattcaatgccatacccatgaagctaccaatgactttcttcacagaattggaaaaaactactttaaagttcatatggaaccaaaagagagcccacatcgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagaaatggggaaaggattccctatttaatcaatggtgctgggaaaactggctagccatatgtagaaagctgaaactggatcccttccttacaccttatacaaaaattaattcaagatggattaaagacttacatgttcgacctaaaaccataaaaaccctagaagaaaacctaggcgataccattcaggacataggcatgggcaaggacttcatgtctaaaacaccaaaagcaatggcaacaaaacccaaaattgacaaatgggatctaattaaaccaaaaagcttctacacagcaaaagaaactaccatcagagtgaacagacaacctacagaatgggagaaaatttttgcaacctacttatctgacaaagggctactatccagaatctacaatgaactcaaacaaatttacaagaaaaaacaaacaaccccatcaaaaagtgggcaaaggatatgaacagacacttctcaaaagaagacatttatgcagccaaaaaacacatgaaaaaatgctcatcatcactggccatcagagaaatgcaactcaaaaccacaatgagataccatctcacaccagttagaatggcgatcattaaaaagtcaggaaactacaggtgctggagaggatgtggggaaataggaacacttttacactgttggtgggactgtaaactagttcaaccattgtggaagtcggtgtggtgattcctcagggatctagagctagaaataccatttgacccagccatcccattactgggtatatacccaaaggattataaatcatgctgctataaagacacatgcacacgtatgtttattgcggcactattcacaatagcaaagacttggaactaacccaaatgtccaacaacgatagactggattaagaaactgtggcacatatacaccatggaatactatgcagccataaaaaaatgatgtgttcatgtcctttgtagtgacatggatgaaactggaaaccatcattctcagcaaactatcgccaggacaaaaaaccaaacactgcatgttctcactcataggtgggagttgaacaatgagaacacatggacacaggaaggggaacatcacacaccagggactgttgtggggtggggagaggggggagggatagcattggaagatatacctagtgctaaatgacgagttaatgggtgcagcacaccaacatggcacatgtatacatatgtaacaaacctgcacgttgtgcacatgtaccctaaaacttaaagtataataataaaataaaatgaaaaaaagaaaaatcagttgaccacaaaaaaatgtaaagaaatacttttatttattgtttccttcttaagtacagaaataatcagtataatacagagagaaagaacacattctctagaatcagactttctgggttcaaatcctgactctattgttaaataaaataggcaagttactcaacccttctagttacttctttatctgtaaaatgaaaataacagtgatgtcttccttatgcagttataaggattcaatgtctaatgtatctaaacaacctaagtaagctgtatggcacataataagcaccaatcaatgctagctgtgtttctagacctatcataagcattatcttttaattaataatcataattaggtttatatttgtttcatgaatagggcaaagtaagtgaagattggatttgcatatttatgagcattaggaactagagactttgacatatatattacctagattaaccctcatcaaaacattgcaagaaaaatattattttagtattttataaataagaaaatgaaaggtgagatatcaagatgtagtagaccagtaactggcaatgcaagaatcaaaccatgctgtctgactctgtagtttatgtttgtccccattataaaatattgcaaagatatgtatgtatatgtgctgtgttacacacaatatcataaatgcaagaaatttaaaaaggctttttttggcaaaggaaatcttacttgtggcaaaattcagttgaaataatcctaaccttgtaataagaatcaagaatagagaaaaaatgcacttccctaatgattagtgatgtagagagttttttttcacatatttgttggccatttgtatactttcatttgagaaatgtctgtttagttcttttgcccattttaaaatcaagttacttgttttcttgttgttggtttgtttgaattccttatgtattttggatactaacctcttataagatgtatggtttacaaattttttctcctaatccattcattgtatctttactctattgcaagcttgtccaacccgtggcccacaggctgcatgtggcccaggatggctttgaatgtggcccaacacaaattcataaatttttgtaaaacgttatgagatttttttttacgattttttttcttttagctcatcagctatcattagtgttagtatattttatgtgtggcccaagacaattctttttcttccagtgtggcacagggaagccaaaggattggacacccctgctctatagattgttttctttgccatgcagaagattttagtttaatgcaatcttgtttgtctattttgcttttgttgccagtgctttgaggctaaacccaaaaaaataattattcagacaaatgtcataaagctttccccttattttttcttctagtagttttatagtttcaaggcttacatttaagtatttaatccattttgagttgatttttatatactatgatttaagggttcaattttattcttctgcatgtgtatacccaaggtccctcaacacgatttattgcacatactgttctttttcaattatgtgttcttggtacctttgttaatatcaatttattgtaaatgtgtgggttcatttctgggctcactgttctgtttcattggcctaggtgttttttaaaaaaattccagtaccataccattttgattactatagttttgtaagatattttaaaataagatagtgtgatacctttagattgttcttttgatatatgaaaaaatgttcaacagtactaatcatgagggaaattcaaattaaaaccgcaatgatatattacctcacacctgttagaatggctatttaaaaaatggaagataagtgttggcaagaatgtggagaaaagggaacccttccttgtacactgttgttgggaatgtaaattagtacagccattgcgtaaaacagtatgaaggttactcagaaagctaaaaattaaacaagtattatctgattcagcaatctcacttctgtatacatacccaaaggaattgaaatgagtatatcaaaagatatctgcaattcccagtttattgcaacattattcacaatagccaagatatgtaatcaacctatgtatacatcagtggatgaatggataaaaaacgtggcatatacacacaatgaaatactagtcagcctttaaaaagaaggagattctgccatttgcaataacatggatgaacctgaaggacattatgctaagttatataagccaggcacagaaaggcaaatacttcataatctcacttacatgcataatctaaaaaatgtcaaactaatagaagtagagagtagaatggtggttaccagaggtgatgttgggagggaatgggagatgttgatcaaagggtacatttcagttagacaggtgatactataagttttcaaggtctactgaacagcatgatgactatagttaataacaatgtattgtgtattttgaaattgctaagagaataaatttcaaatgttctcacaacaaaaaaagataaatatgtgaggtgatggatatgttaattagcttgattccatcatccaaaaatatggatatacatatttatatatatatataatcacattgtatatatataatcacatcatatataatcacattgtacctcataagtgtataaaattattatttgtcaattttaaaaaggaagagaatacaattattatttgtcaattaaaaaatgagtaaaaatagaaaaaatgttgcttttttaaattggcaaattattattatttgtctattataaaaagaaaacatcaaatactgaagaaaacgtggtatatccacaagagaatattgtttcagccattaaaaaagaatgaaatcctgtcatttgcagcaacatagatggaactggaggacattatgctaagtgaaataagccaggcacagaaagacaaataatgcatgtactcactcatatgtgggaactatatgaaaattgatctcacggaagtacagagtagaacggtgattaccagaggctgggaagggtagggtggaggggagttaaggagaggttggttaatggatacgtacatacaggtagatataaggaatacattccagtgtttaataacagtagggtgactaggataaaatatgcaacagtaatttattgcatattttaaaatagctgtaagaaagatttggaatgctcccaacataaaggtataataatttttgagctgatggatatactaattaccctaattagattactatgtattgtgttcgtgtatcaaaatatcacatgtacccccaaaatatgtacaataattatgtatcaatatgaaatttcaaaaaggcaagtgaatttctatgtttgttaaaattaatggcactttctgattgtattcatgtcttactacattatcacaataaatgggagtaaacacaggttttgtaataactactggatttgctttattgtttttatgcctttttagagcagtgctgactaatatgatagccacttctacatgtggctatttaaatttaaacttacataactagaataaaataaaataaacttattcatttgtttgtattagccatacttcaagtgttaaatagctacctgtggttagtggctactgtgttggatagttcagatatggaacatttctatcattgaaaaactttttattggacagcactgttctagagtaaatcaggatgtagaatggaatgataagcaggaaatttcagtaggggggagattgccagtctggcgacagagtgagacattgtctaaaaaaaagagagagagagagagagagagagagatacagattgcctaagggtagctaccaattctttgcagttcaaagtagtagaaataacagttgttttgcattctgtaggaatgaactctacttgcactacctgtcagtttgggcaacattcaccttcccagagcttcagttttttgatttgttaaatgagggataacaatttctaccaggcctcacttccaggatttttgtgaggatgagtacaacgatatatgtcaaagctctatataatgattgtataaaatctataataattgatataattctcagttgtgtgtgtgcctgtgtgtatgtttcatgaagtattgataatgatggcaattgttatagatttcatatgctgagcttcattttcctgctagaaattcatgatgcctgaacatgattccatctctcctgaatttgtacttgcagaatgagtagtattaacagataacccatagagaacctttttcagatgattgccaaacactgaaaggctttagatatttcctcctaatgtttatcttttcttatctttttaaaaaagaataatcatttccacttcttcagtactactggaaaaccacaaaaaaaaataaaaacttttctaggcctttcaaagtgtttcacatttactgccacacatagagagcaggatttactgccacacatagagagcaggaggaatatttaatcaaagggtttaaagcatgtggtattggcaatcaatgtacaactcagatatagaaggctctcctgattgcaagtcgtaccatgaggtggggtagataaagttactagaattagcaaagagctattagttttctttaagcttcactgtttcaattagaaacagtagttgaattgtatacatggtaatattatacaagcccatcagaagtttcagatgttttctgactttgttttgtttttagctatttttcttttaagcaaaagcttttaaagaacaaattgcgtacattttcagcatacactgctgggttaaaatatttatataatttcagaatgatatgagatagatacagtctaatgatattcattgattcatcggtcaaaataaaaacttttctcaaaatatctgaatgaaaaataattggtaaataatcatgaatttctatataaaattcctacaatatttttcttttttgggaagatatttcataatacataacagaaatttaaaaatttttttctagttcctgactttcatttccctagaaaacttactattaaaatgttagttttataccaagatgataacatgcctttttaaaagaaagtagaatacattagtttttaaaaggagatattatggttttatgattaataataatatgaataacaatattattatgacaaattattaaggaaagatgcatggaaataagtggaaatgtgtcctgaaaatgtggaaatgtgtcctgaaaatgtagaaatgagagagggacacaaaaataggtaaaccacaattgcattatatatgagcttgaacatctccatgatatattaacattggaaatctaagtcatatgggtaatttcaaggtttttttaaattacaacaaagtacataaagataaataaattggcatggaaaaagagtcagacaaaagttccagtcttttcacaaagccagcattttagcagtttctcaattaccctgaacatttactactgctgatactgcacaatgagctgtctcttagaaaaatgtgaaaatgtgtacatattgtacatattgttatattgatcactaagcagggtagtaaaggaagacaattggtaagcagaagttcagattaatagtataaaatatgatgtaaatattaaaacacagggaaggaaatgtgctatcaaattcttgattcagcttgctatactggatattctccaagagtaagagatttagtttataggctaaatctaagaatggaaaaatggaaaattactccatttcctctgtggctgttgctgctgttgtcactttggtgaaatgtatagccacaggaaatttgacatttatatttcttgttacaattaatgcacaaaaaactatagaaaaccttaggacacttagaaactgattttatctttaatgtaattatcttaactataaatcttgacaaaatctacagccatctgaacaaattcttaattaaaagaaaaaaggagaatcagacattaatgtcaggaaatgagttctgcacccaagttgagattctttattttggaaaagatacacaatggtaggagaaaaggcaaatatccatatgaactaaatgcctcttgtgtaaaagatacagtgctaggctctagaaccacaattttaattccaaaagatccctacatacaatcttatttaaacctccacaattttcagcaaacggagcataataaagttaaatatatgtgaccaagattactcctagatagggcaagaactggaatacaaggatctttcacatccaagaccctgttctttctagttagctgtggggccaaggcacagcatgcaaaacctgtcatgtacatggcacggagctcttggctttcctagttcctaattcagtcatttaatagtctgtctgtatctacagaattactttcatgaccaagaattgatatttttgttattggtcaaatttgaacatactagtactgagggcaaagctttgcagcatgtccttagaacccttcctccaggtggagataattctctttatcaacacaagcggaggtttggcactgaaccaatattaaccgcaacttgaaagcagttcatttttctttacctgattcacaaggctaacagaagactagaaaacatctttcctgaatttagacaaactttgtctattccacttccacagtaggaatttttaataaataatctttgacgaatgaaggtggatctgatatagtataacattcacattgtttccattctctatatagacaccacttctttattcttattgatgcattttataattataatcatttaaatattatgttttatgtccaatcatacagctgttgattagtataatttattctctttccatcttgctaattagtcattggtcttgtagcatttatgttgtacaaggccagtgttgtagatagttactccaagatgtcagtagggagtcatttgtgcccctcacgcatatattttgggatgtattttgtcattgccaaggatttttaaattatttataggagaatgtgactacattttcttccaacctgagatggaatgaagtagtctttatttatggaaatactatgtagaagagatggatagcaaatcttttctgtttccaaagtgaatgagttcaaattgtagtcatatggatttagtgagctgtaaataagatgctaactctaagaagcattacaaatgactttgagaagatatctatagttttcttacttagggaacagtatgatataggcaagactaagaaaataaaatagcatatttaatttcttttaccaaatatcctaaatatgaaatctgttagcccctctactcatttcctccttacagtcttcgattttagtacagaataggagcaaggcaagggattcatgaaattttagattcttatcagatctatcattctagaatagttttttacaactgcaagtgtattttaagttagtttgtgagttgaacactagatatttaaaattcaacttttcatatgccaacctatggtgtattgaataaagacataaagtttcaaattttgttgtataattgttataattttaaacagatagtttcaataatgattttcatacattgcattttagccaatgttttaataggtagccaaaatctttgactatctactaataagtagactaaagttgacaaggatcagtttccttttctagatactaaattattctcaaattggaatgtaagcattaatataacttggtcagcaaacaggataatgttaagaaagcattctctcttaaaatttatagaagtatcataatttcaatttccaacttgaatatcatagtaatgtattgaatagtacacattttttgaaggagagctttggcaagattagtaaccaattatcattgaaaaaaatgaactaaacttagcctaggctttgaggattgtgtgacaattgttattctatattttgaaattagttgaatatactttcctttaaagtatagggatttttaagttaaatacttggctacatttaagaggttcaacactctaattttaatggtaaggaaacatttttaaagctatcagcttatttctcaagggtaatattcagtctttttacctagtgctagttaataccagtgttgttatttttaaactattgctacttaggcagaacataataaaaatcgagtgggagtagttaatccaaaattatctaaaagtttcatattaattcaaagtttaaatatgctaggttctatataacataaaaatgtgagatatttctactggctatacttcaaagaatataattcacaaggcttgaaattgaccacagttcctaaaagtagtgggagaaagagaaatggaagcaatgctcttcaatatttacaaaggtcttctgctcgtgactagcctaaaattttttcagctcttatatattcttgtacatgagtaattgggagttcaatcagcatctgctagcctttcattatttattatttatttctgtgggtacatagtagaggtatacatttatgagttccatgagatattttaatacaggataatgcggtatccatcacttcaagcatttatcttttgcattacaaacaatctaattatacttttttagtaattttaaatgtacaattaaattattgttgacggtagtcattctgttgtgctatataatatgggaacttattcattcttcgaactatatttttgtacccaataacacttcccacttcacccctactttcccactacccttccaacctctgggaccttccttctactctctatctccatgagctcaattattttcatttctagctcccacacgtaagtgggaccatacaaacttcatctttctgtgcctggcttatttcacttaacataatgacctctagttccatccatgttgttgcaagtgaaagaatctcattcttttatggctgaaaagtactccattgtgtatatgtaccacatttgctttatccattcatctgttgatggacatttaggttgcttccaagtcttggctattgtgaataatgttgcaataaacatgggaatggatatgtctctttgacatgctgatttccttccttttggttatgtacctaggagtgggattgctggattatatggtagtgctatttttatttttatttgagaaacttccaaactgttctccatagtgtttgtgttaatttacattcccatcaactgtatgagagtttcctttcctccacatccttgccaggatttgtgattgcctgacttttggataaagccattttagttggggtaaaatgataactcattgtagtttggaattgcacttctttgatgatcaataatgttgagcatcttttttatgcttgttggccatttgtatgtcttcttttgagaaatgtctattcagatcctttgcccatttttaattggattattagatttttttcctagagagttgtttgagttactgatatattctggttattaactccttgtcagatggggagattgcaaatattttctcccattctgtgggttatctcttcactttactgattgcttcctttgctgcacagaagctttttaacttgatgtgatctccttttgtccattttggttttggttgcctgtgcttgttgggtattactcaagaactctttgcctagttcaatggcctggatcattgacccaatgtttttgtgtagtagtttcatagtttcaggtcttagatttaagtttttaatccatttagatttgatttttgtatatattacatagcccctttgaggctgttttctagatgctgtaggtatgcttcattgtttttttatttgtttttcttttgtttcctcttactgtacattttcaaatagcctgccttcaagctcactaattctttcttctgtttgatcaattctgctgttaaaagactaatgcattcctcagtatataaattgtatttttcaactccagcaatttttcttgattctttttaattatttcaatgtctttgctaaattgatttgatagaattctgaattccttgtgttctcttgaatttctttgagtttcctcaaaattgcagtttggaattctccgtctgaaaggtcacatatctttgtttctccagaattggtccttggtgacttatttagttcattgcatgaggtcatgttttcctgggtgatcctgaaggtcatggatgtttgtctgtgtctgggcattgaagagtttgttatttattgtagtcttcacagtctacgcccatttggacccatccttcttgggaaggatttctagatattcaaaaggacttgggtattgtgatctaggccacatctgcattagggggtaccacatacctagtaaggctgtggttcttgcagactcacagagatactgccttgttggtcttggataagatccagaggaattctctggatttccagacagaggctcttgttctcttccttcactttcttccaaatatagtcccttttcctgttctgagccacctggagctgggtgaggtggatggggtgacacaagcagcctgtggccaccaccactggaactgcattgggtcacacataaagcaaacacagcactggggttcacccaaagcctgttttaatcaccatctggagatatacctaatgtaaatgatgagttagtgggtgcagcacaccaacatggcacatgtatacatacgtaacaaacctgcacattgtgcacatgtaccctagaacttaaagtataataatatatttatatatatttatatataaatatgtattatttatatatatttatatataaatatgtattatttatatataaatatataaaataaatttaataaaataaatatataaaataaatttaataaaataaaatttatataaaatatataaatatattatatataaatatataatatatatttaatatatataaatatatataaataaatatatattatatcatatataatatatatttatatatataaatatatataaataaatatatattatatcatatataatatatatattatatatgatgtatataatatatattatatatgatatatatattttatatataataatatattatataataatatatatatcttatatataataatatatatatctcatatataataatatatatatcttatatataataatatatatatctcatatataataatatatatatcttatatataataatatatatatctcatatataataatatatatatcttatatataataatatatatatctcatatataataatatatatatcttatatataataatatatatataaaataatgaccacctggctaccatctatgcttgcaggctggcatactacaatgagcaggtggcgaagccagccaggcttgtgtccttcccttcagggtggtaagttctcccaggtagatccagaggtgttctggtgggtccagagttcctcctaggtgggtccagaggtgctgtctgggagtcagggacaagagtcaaaaaccttagaagtctactttgtgttctattgtactgtggctgagctggcattcaaaccacaagaatcagttgtttcccctcttccgtcttcatttcaaaggcagaggacacttcctgtggccaccactgccacaggcctacagggagtactgccagactaccacctatgttcacttaaggcccagagtgttttaagtcagcttgtggtaaatgctgcctggcctgggattcacccttcagggcagtgggctcccatctggtccaggtaggtccaaaaatgttgtccaagtgtcaaggtctgtaatcagagaccctaagagcccactttgtgctctacctccttgtggctgagctggtacttaacatggaagataaagtcccctttacttttcccttagcttttctcaagcagaaggtgtttttccctatagcccccacagctgggaatgtgctgagtctcacttgaagctagcatgtctcaggctcacccaaggcccatggtgtactacctgggtattgccactggttattcaggctctcaaaggctttttagtcagtcggtgatgggtcttgctgtgactgggtccttcccttcaaggcagtgggttcccttctagtccaggttgtgtctagaaatgtcatcctgcacctagaacctggaaagggagcctcataactctgactggtgccctatcttattgtggctgagctagtatccaagatgcaaaacagtcttctttactctttcctctcctttcccaagtggaaggagccagttccttttgaacccatgagccctgctgcctgggattgtggggaggtggtacatgcacccccttagtcagccccactgatgtctcagtaggttgtacaccacccaagtccactggttgtgagccccgcacagcactatgactcacataggagttgcggtctttgtggcctatactgcatttaaagtttatttagagtcccagaggactttagcccactgtggtgaggcgtgggagaactcaacttctgacccgtgggatgggtgactcccatctggctagggctggattaaatattccctctatgcacaggcatcagctagatttggatcagttttgctttctcctgtgacagggcaatgtctaacaattgctgtcctttctctcccaagggcaaagattctctctccatgccacatggctgctgctggggatgggatggggtgtcactggcaattcaagactgtctttactacactcttcagtgtctctttcagctatatgaagttaaaatcagataccatgagagctctcgtgatttttggttcttaggaaatgattatttttgtgtgtagatagatgttacattggtgtccttctggggtgatgatcagtggaggcttctatttgaccatcctgctccaccccgtgtagtctcttattattaagagtctggctcagagtagtgtatagaattgtttttcccaatagtcatgattagtttgcactcatgtagccaatacttttttttaatgtctatgtccaatctgtaatatcaaagatatattctctaggagacaacatatgaataaatggtccatccagggtagaacttctgtgttttaagtaatgatatgaaaaaatccaaaataacatgattattagtaatagctgtattctaaacaactccagaacaatattttgactttagataaaaagaaaaaaattaagagaagggccagctatattttaaaattttattattttgaacaatatgcatattagtgcctagatatcaatgctcataccaataactgactgtaaaagaaatctaaggacaaacagatttattatgagaagtccatgatgtaaggggccatttcgtattatttcagcctagaatacaaaccaagaggaagacatataaactggaactttaaaatgtcttacttttttgaaatattctagaagggtcacactcccagtctgaattagtatttctattttgaaactgtggagtaatgaaatcaaaaggtaatgttttgccttactctcaccatttatttagagacaaaattaaaaaaaaaatccctcttcctttttgttccctctgggactctgaattcaaaaacaaaagaaacactcagattaaatttttatttctttctagaaaaacattacatgcatatgaagaaaaactataatctacaatcactgggtttattttaatttgtttaggcgtacacagtgaaatgtttaaaaaaaaagctgaaactggatcccttccttacaccttatacaaaaattaattcaagatggattaaagacttacatgttcgacttaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcacaacctactcatctgacaaagggctaatatccagaatctacaatgaactcaaacaaatttacaagaaaaaacaaacaaccccttcaaaaagtgggcgaaggatatgaacagatacttctcaaaagaagacatttatgcagccaaaaaacacatgaaaaaatgctcatcatcactggccatcagagaaatgcaaatcaaaaccacaatgagataccatctcacaccagttagaatggcgagcattaaaaagtcaggaaacaacaggtgctggagaggatgtggggaaataggaacacttttacactgttggtgggactgtaaactagttcagccattgtggaagtcagtgtggcgattcctcagggatctagaactagaaataccatttgacccagccttcccattactgggtatatacccaaaggattataaatcatgctgctataaagacacatgcacacgtatgtttattgtggcactattcacaatagcaaagacttggaaccaacccaaatgtccaacaacgatagactggattaagaaactgtggcacatatacaccatggaatactatgcagccataaaaaatgatgagttcatgtcctttgtagtgacatggatgaaactggaaacatcattctcagcaaactattgcaaggacaaaaatccacacaccgcatgttctcactcattggtgggaactgaaccatgagaacagatggacacaggaaggggaacatcacacaccagggactgttgtggggtggggggaggggggagggatagcattaggagatatacctaatgctaaatgacgagttaatggctgcagcacaccaacgtggcacatgtatacatatgtaacaaacctgcacattgtgcacatgtaccctaaaacttaaagtataataataataaaattaaaaaaaaaagaaataaatgacagaaactaaccaggtactatagagaaattattctgaaatacatagaacctaacatcagtcattgactctgatgatacctaagatatagctataagaaattatcccaagaaaagagtatctttcaacatgagcaagatgttatataaggcgggttgaaattacaaaggggagagagatactgttcatgtaagagggccatgtttttgaagctctcctcgctttaggattcgtttgtaggtgccagaggccatttggttgtttgtgcacattatttttaagtaaagctttttgaaagaaaaataaaattgaattacatacacagtagatatatttttgtacatcctgaaatgagtaaattgatctgggaaagctcattcttactttttgttttcaaatgctagaaatcatggtaaatgttaaccaaacataaatgtggtctagtattatttgtcaatatcagagaaaaagcactattaaaatggaatccattttgtacattgcatttttaaaacctgattgatcactgttaagtgagtttttgtagctaagtgtttttaagactgttgactgaattttaaaggaaatgtccatgtgttgctagtagtactgtgtaaataagtcataaatggaacaaacaataatgattggcataatcagtaggattcattcatctttgataaaacctctccaagatgcattaggtacaccccaactgtggagaaaaggatggaatgtgtttccttttaactccacaaatttatgaaaaaaatctaacttatttagtcgcataacgatagtagaaaaaatctcaataaaataatcctagtaaaatataatattttagaggtgtttttgtttcatgtaaattagaaacagcctttttaatgtcactcaataaattatagaatagtattaatacaatcctcatcctttaatcatacatacatataaaatgtcttatcaggggaaagaacacacagagaaagtgagagagaaataaaaagagacgaggggatacaggaaagatagatgtatattagaaaattattgcactttctagaagagatgtcattcctgggataaaagaagccttgagcagattatagaatacatcagaggcattcttttcaataaatgacaaagaaagatagagttgcaaaaatacaatcaactggaatagtgaaattttagcaatttcagcagagtaattaagaatactttacaaaaggcaatttttaagaagtccttatgtaatgaattaactattatataacagactgattacagtatgtggacagcagcttatacaaaaccaaaagaaaagaaaaaaaattaaaacaaagacattaaaaacaggagtagagcatcagatcatattgtattaacatgccatgactagattgcttttctttctgatataccataacctatacaaatgctaggtaaacaacatggaccagtacctttcttttggcctttagctgctcatgatacttgtcacaggtatctcctgggatttctcctccccagagagtaattccaacaatggtgtatgtaatacccatgatgagcaatgggaaacagtacaccagtataatgacgataatatggtaactatgaaaaataagaaaaacacatgctgaagaccttattggaatgaaatattggggactgaattggctcagctttaaatcataattaaaactaccaagagttatttctacattatctctatacattcatctcaaaattccatcaaaatatcatgctattgtcacttatatttatgtttcaaatgctgccagttgatgttgtcaatctttacttggtatatgaaaactatagctgggttgaagggctcagttaaacataagttctccttgcctagaggttgaggaggaacgactttccactgctatgtactctgcttggtaattgttgagctaaaccaattaaatgtatcattggaggaaaagggaagggatagaataaatgaatcaaccggcatatgttttctcctatataggactgtcttctctattgctgcaacatcagacatacataaactgtttttcattcaaatggtgggaaaaaagtaagtagatactctgagccataattaatccacaagttactacaatttttaaaaatcaggtaaagacatttacatgcaattttccagtctgggtccatttgattgcattgttaacttggtaaaaacaaaacaaaacaaaacaaaacaaaaaaacatgtcgacatagtagtcaaacgagaagtatgctgctgtgaattatcaaattaaattctggtatttagtagctttcaatcaaaattataagaattcaattagcgaggaaaaggagagtaagccatactacaatagcccaaatataatttataattttacaaaatttgtatggatttcactgtcttggaaagctttaaagtaattaaaaagtttgttagaacggtcttctccataccagtgttttttttgttttgttttgttttttgtaaagtgaatcttaaatatccttgcctttccatttctcagtagattactaagtattgatttaaagtcaatgaggaaataattcagtcaacaaataatttgaagatgataacattatcatacaattaagatgtattaataatatgaatagggtactcagtttaatatgagctgtctgattttccttaaataagtgcctcctaatatttttgttcaaaaatctgaactttgggtagagcaaaggtagataaaatgactgctttaaatggcaaccattatttgcaccatttgttatttttaaagggaaaaattggtgagtaaaatagaaaaataagtacattattaaaataaaatttaagattataatttaaaaatcaaatgcaataaattacacaattacattattattccttcttgctctatttaatgtgggtataaaatatgaaccaaattttaccatatattatagcatttgtatttccttttcaatctagtgttcaggttttttaatgctttttgcttgtctagagacaagcaaaagaacacaaaccaaatcaaaccaaaataaaattagataacctactagggtgctccttcccttcagctacacttcctaaaagagcaatcaacacatttgggctttgatttcttccttctcactcatttctcaatcaataacacaatgcttttctttgcacattgcttttatcttttatcacttccttcaggaaactctccagtgccatcccacatagacatcctcatatttccaattaaaaaccttagtaacttacacaacttattgaccacacacaaatcataccatattacagtatttttatatatttccttttccaaataatgtatgaaccctgggggaaatgtcagtcttatttaattgttgctcctaatctgtagtttcctaaatgtttgataaactgaattgaaaaccataatagagaattaacttacgtgaaatgttgtttgggaccttctggccattgcacaaagcagagagtacggcctggcatgactttggttttggaataaagacactgagggaaggcaagtagaaatgctagaatccaaatacttccaatgacaatcttggttgctgtagcagacagtctgggtttcaagggatcaataatagccatatacctatataaaaacaaacaaaaccatttcattggttttctttataacagagtttgaaatggagtttcaaaggtatttcaaaggcgtttcaatagttacagtcattgctcttttgggaaaccagttgataaggactgcttgagtagaggcagcgtagaatggtaatcatggcatagtctaggaatcaggaagatctaggttcaaattctattctgacacttgtttaaactttttgaacctcagctttattatttttaaaattgaaataagaacacccatctcttggggtaaagtgaggatcaacagatgtaagtcagcggtgcccagccttttggcaccaaggatcggttttatggaagataatttttttccatggactggcagtgggtgagggagcgatggtgtggggatgattcaagggcattacatttattgcacactttatttctgttgtgattccattgtaatatataataaaataattatacaacttgccataatgtagaatccgtgggagccctgagcttgttttcctgcaactagacggtcccatctggggttgatgggagacagcgacagatcatcacacattaagttctcataaggagcactcaacttagattcttcgcacctacagttcacaataaggttggctttctatgagaatctaatgccgctgacctgacaggaggcggagctcaggcagtaatgcagcactggggaatggcagtaaaaacagatgaagcttcttagctcaccagccaccactcacttcctgctgtgcagcctggttctaacaggccaggaactggtactggtccctaacccagggaactgggtacctccgatgtaagtgaaagatattaatgatttggtattgtgcctaacacattagaattcataaatgtctgttgaatggaattggaaaagcacttaataagtgcttacaaatactggtttcacagctcaaaaccttcatgtctcctctgtatgtttaacttttaaacatataatttctagagaaataatatggattataccacatacttgacaaagatgtgaaactcctataaaagatatggtccataaacccatttaagagcagcaggagataagttcagaatttccgtgattaataaatcaagttcgattgaggctatgccttcctgttatacctcatattgaattcatactgcctcatgaacatcttcatggtgcctatctgtgtaactacatataacactgttgtaacggaaaaatatatttgagtctctaaaaagtatacttaaagcatacttaaatatgacttttggagggcaacttcttggggaagttaggaattctgtaaatatggtaagtagagtcatgctttattaacttagtaccagagtaacaatatagctgaaagaagcaacttccaattttgaactggagatagcatggctaattgccaaattctagctaatgttcagagacaaaaataatatgtaccaaacaaattagctttttgtattttaataaaacacgatctttatgttgtttcaattctacttttggtcattttatgtttatagaatatattttgatttatgaaaaattttcagacgtaatactttcatcaaagaatgaatatcgcataggccaaaaaatgttaaccttaagaataaatatttcaaaataaggatattttatcaatatgtttataaatctttgttgttgtaactactgggcagaattaaattttcagaagatattgtgaaaattatctatataatattcttaatattaactatagtcatgatttacctaaagaaaacagtcttaattcattatgtataacagccattaggtaaacatgaaacttagatttgaaaaataatcatatttgtccttttgtgactggcttaattcactacatgattccaaatatatgtagtatctaaaagagtgaaacttatgaaagcatagaacagataatgattgctcagggctcaatgtatataaagttttaataatgcaagataaagaagttctagacttctgctgtataacatagtacctatagttagcaataaattatcatgaactttatcatgttaaaaggatagatcccatgttaagtgttcttaacacacacacacacacacaacaaatacacacacataagaacacaaggaaattttttgaggtgatggatatgtttagtgccttgattgtggcgatatcatgtttttccaagctcatcaaaatgtatacattaaatatgtgcattttttgtatatcaagtatacctcaataaagcttacagaaagagaaaagaaaaagtagtgacaaaaaaatacctaagtttaggaaaacagtgtgaactctacaaagaaaaataatgcgtatgtttcaaataggagactttaaaattcaactctcatggttattttggtgaagataataataaaaaaattgattgttaaccataactagggtacataatgtatgtaatagggttacatacatcatatatacttaatagccataataatccaaccacagaataatactattacctctattttacagaaaggaaaactgaggcttaaaagattatgggaattgttcataatgatccagataataagagaagagctagaattttaagccagttttgccagtcttcaaagacaatatagatacagattatagattttgaatataaccatttattttaggagagaaatatatatatttctcctccatgatatatatgttagatacttatgtgttatatgtgtgtgtgtgttagagatacccaccaaagaatcagaagtagaattttgccattttgcatttttgaatctaaaagcctttatgtgtaacattaaaacaaaggtaaaatatataaaggaattatatgtgggcatttctgttcctgctcatgttgattataactcacatagcatttatttcaatataggaattatttctgtattggtgtttcaaagccaagcacctgtcaataaatttgttgtactgaactgaatatccctcaaatctcattataatcttttgctttgttgcttgctctggcatctaatgaatgtgatttaggtatttagacagttgattttctgagagtaaagggagaagtggaataacacaagcaagcttaaagccctgtacaactcctgtagcacagataattcaaagtaaattgcaaatcgcattgattcttctggccagtctaattagtctaatgctagagaaggtattttctgaaataatttctacctgttagaaattaatttctaacaggtaaaatatcattttacttgaattacatggaaataatcagtttatgttctcatgaacatgttagtgatagtagagatactgaaacttctagcatacctttttgtcatagctggtctgatccatgattcatttattcaataaaacatttattgaatgcctactatggtattccaaacactagtgatccaacactgggcaaaaatggttttctgtgaagtagaaaaatacttcccaaattgtgaagtccataccatttgtgaagcagacaaatactaatcaaataatctcaccaataaatgtaaattacagatgtgacagctgttacgaaggtaaggccaagtgtatacatgaactgagaaaaatgtatttagattgtacttcaattgtccctaagaaaagtcattctaggttgaaacttggaaggataaccaggcaaggtggcagaagagtgagggttgcaaagatttctgggagaatgaacagcatgtgaaaaactcctatgttgatggtgttttttttttttttttttttgagactgagtcttgctctgtcgcccaggccgtaagtgcagtggcacgatcttggctcactgcaacctccacctcccaggttcaagcaattctcttgtctcagcctcctgagtagctgggactacagatgcccgccaccacgcccggctaatttttgtatttttagtagagagggggtttcccatattggttaggctggtctcgaattcctgacctcaggtgatctgcctgcctcagcctcccaaagttctgggattacaggcatgagccaccgccccagcctgatggtgggtttttacggtttgaattgtgaccctccaaaaaagatatattgaggacccaacacccagtatcacagaccttatttggaaatagattctttacataggtaattgggcttaaatcaggtcattagggtggtctctaacccaatatgactagtgtccttgtttaaagggaaaatttggaaacagatatgtagggagaatgttatgtgaagacagaagattgaaatgtggcatcaacaagccaagaaacagcaaagattgccagcaaatcaccagaagctaggttaagacaaggaaagagtcccctacaggttcttgagggagcatgtatcatggagcatcgatttcaaacttccagccaccagaacaataagactataaattactgttatttaaaggcactcaaatatgtggtacattgttacagcagccctaacaaactaagacagtgggtacaggtggaagaagcatcatattctttagtaattacaggatactgcaattgatacacagaaagtaaagagggaaggtggtttaagatgaagttatagtacaggttgtggattttttttgccagtggaaagtaattgaggcaattttatcagagaagtagaataatcagatttcctccagaaaagagcttcgagcttcagtctggagactggaagaggaaaagaatggaagcaaatgttgggcacagtggctcacacctgtaaccccagcactttgggagcccaaggtgggcggatcacttgaggccaggagtttgagaccagcctggccaacatggagaaacctcatctctactagaaatacaaaaattaacctggtgtggtggcacaggcctgtaatcccagctactcaagaggttgaggtatgagcatctcttgagcctggcaggtggaggttgcagtgagcagagatcacatcactgccctccagcctgagtgacagagcaagactctgtctcataaaaaataaaaaacatatatataaagaatggaagcagggaagtaagttatctaacttatgttctgatttggttcagagataattgctgcttagattagggcattaccactggaggttgaattaagtgaatgatttgaggaaagtaaagaaataccaaaatactgttgtagaaagggacacttggttggccaaagaaatagggagaattgccaggctctgatgaaaacttatttgaaattgttgatttggaattcgtttgggcaccaatattttctattttgtaactttcttcagcaacaataatttgcgtggagaggatggatatttaggttcacctgaacaaacattctctggaccttgagaataaatagtcagatgtgagatataatttcacccaaataattgtcagtgctttattgctttaaaaaatattttatgtgattacatcagcttttccaaggatttttgctgagcttctcatcaccattcttccttcaccagattcttaaagacattagaatctccttagtaggattatttcataagtaacagctaagagctgattctttactcttcatattagcataccacctaaacatgttttaaagtcactttttattatcctttatagaagctgaaattctcagaagcatctattgaaaactaatagttttaaagccacctcttaaaagttttcctttccactctaatactagaccgctttgctttaccacttactatttttctgatataattgaggtggtcttttatgtttacttattgtcttttgaaaggcagattagtttggatgtaacttttgtctgatgtcaataagaaagcctttccaattttgtaattgttatttgtatctattataattcttccttttgttggcatttttattaagttgtttctggatttttatgagcttttacatatcttcaagtttttcaatgaagacagaatccagccttcagatgtttatttgattgtagaaactatgcaaaaaataatttgcctaaaatgatacgaattttactctcttccaatcaatttgctcctggtcatagtagcatatgttctagtctgttaagtcccaaacacaaaatacggtctggctactctctgtgcaaaataaagattagttgcaacagctgctcatgacccatgaagtttcaacttctggccttcagtgctagggtattttctgcttctctgctttgacaaatcatttgagagatacatgacctttgtcaaaatgcattttctagatacattttattttgtgatttttttcataactgccttttctattctttgtttgtttgtttggttgatgggcctcttgctctgttgccaaggctggagtgcagaggtgtgatcacagctcactgaacctccaactcttggctcaagtgatctttctgcctcagctctctgagtagctgagactacaggtgcatgcctggctagtttttttttttttcctgtatttcttgtagagatgaggattcaccatgttgtccaggctggtcttgaattcttgggttcaagctttctgtccaccttggcctcccaaagtgctgggattacaggcatgaaccaccaaacccggcccataactgtcttagacaaacttaagaataaatgaatcatttagatgattataaatgttgtcttaataaatttcaaagtgaataagcttttattaaaataatctatatttgctgactcatgtatgactcatatatgactatgactattcatatatgtatatatgactatgactattcatatatgtatatatgaatatatacatataataggatattatctgtcaagaaacaaatcacttgttcatctaaaattctttgatttttataagtaaaatgtatatactgatatttgagggaaattatatttaaaacagcttcagaatagtgaaagtatttgtttctatgttataggcattcaatttagatttagaattaggtttatctactcatttatgtatttattttaaagaacttcttgaataccagctatcttctgggattttgttatcttttttggcaatattgatgaacaaaatagaagtagctcctgcccttgtggagttcagagtctaatgcagaagaaatatattactcaagtagtcacaaaataggttagaaattatcacacaaatttcccttgaagtaacgttgcctccaggatatttggttaaatgttccttggggctttagtgtgatggcctgtgtgctcagtaccataccccatgatttttaaagttaccaatctgacttttaaagttccctctgtcactattcttaaatcagtaaaaaatatacgtatgatttccaaaagaaatttaattatataaagcatttcagatttcaaaattatattgaacttagagatttatgagagaggagaatacactgccattctttgtcctgatgtttgtccttgagtttgttctttttgtaatgttcacctaattttctaaaaccctacatacatcatgggtgactcttcatttacaacctcttgtgaagtttaacccagtccctcactccctcattaaactggtaggtctagctcaaccttttggaaattctggtgaataaaaatttcctcattgtttacagtgtgatattataaagctatgtacaagtaattatgaagcataaaatagggaattagacctcgtcttggttataagtggacacagtggtaaagacattaggtataacttccacaagaaagcaacattaagattagaaaaataagtgggggcttatttagggtgaaggtgggaatgagagaaggaagttgaacagcaaagtcctgaggtaggagaaagcagagtgcatttggggaactatggaaggccagctctacagcatacaggacagggaaaaaacaggtggtactgaatgaagctagagatttaggtattaaacatgacctcattaatatattgattataaatataaattttctattttaacaataaaagtaataattgctaatgcatgaatgcttaggtaccatacactctaagaactttatatataactcatttaatactaaaattttaattttttacttaaatagtaattacaaaatgatttgtatcaaaatgctgcatcagtaaagaatattacatgaaacaatgcctactcaaaatttcagataacagatttagaagtagtaatctatagtggcaatataaaacttgctaaattttttgctacttatactatctctgtaataagtagttttaaaatcagaacatatttgattatttcacccataagacataaaattctaaatcactcttttgaagtccagtttactgacattttgtgtcacctctatattgtctcaaaaaccacttccataagtaacttcaaaagagctgcttcataaagtcacttcagtgtcatcaattacatattaaaaactttgagttcaggccaggcatggtgactcatgcctgtaatcccagcacttcaggaggccaaggtgggtggatcacctgaggtcagaagttcaagaccagcctggccaacatgttgaaaccccttctctactaaaaatacaaaaattaagcaggcttgatggtgcatgcctgtaatcccagctacttgggaggctgaggcaggagaatcacttgaacccaggaggcggaggttgcagtgagtcaagatcgcgccattgcattccagcttgggcacagagtgagactttgtctcaaaaacaaaacaaaacaaaacaaaaacaaaaaaactttgagctcaaatatttttagctcccacatacaggtactgaagaggatagggtaaagaaagtacagttaataaatacaaaaatacaattagatagaagaaataagatctagtgtttagtatcacaacagggcagcttatttagctaatactaatttattgtatatttctaaataactaaataactaagagactagaattagaatgtttctaacacaaaagtgctaacagcttgaggtgatggatactccaataactctgatttgatcattacacattatatgcttttatcaaaatattacttgtgccccataaatatgtacacctattatgtatttataataatgtaaaaatactagtacactaaaagaccacactttaccacttatcttacatgaatgtaagaaatctgcacttataaccccctcaaagttgtaaaacatttaaaagaaataacaaagattaaaacaaattttattaaaacaactttattgagagtttaattccctatgaaaacacttttgaactcttagcagattgttattattattatttccttctgagatggggtctctgtcacccagactggagtgcagtggtgtgatcttggctcactgcaatctctgcctcctgggctcaagtgatcctcccacctcagtctcctgagtagctgggaccagaggtgtgccccaacactcccagctattttttatatttttagtagagatagtgggatctcaccatgttgtccaggctggtcttgaaatcctgagttcaagtgatgagcccacctcagtctcccaaattggtgaatcaccacacctggccagaagattatttttttgaaaacaattcctttactgacatacaggagaaccttggatatgttgtaggtctggttccagaccaccacaataaagtaaatattgcagtaaagcaagtcacagaaattataggtttcccagcacatttaaagcttatgtttccactgtactgtagtctatcaagtgtgcaatagcattatgtctaaaaaatgtacatagcttaattaaaaattacttactgataaaatgctaatgatcatctgatccttcagcaagtcataatcatttgctggtggagattcttgcctcaatattggtagctgctgactgatcagggtggtggttgctgaaagttgaggtggctgttgcaatttttgttggtatgtaagaatgcttactttttaaattttatttcaatctttaattttttttgagtacataacagttgtttcggccaggtgtggtggcccacacctgtaatcccagcattttgggaggccgaggcaggcagatcacctgaggtcaggagttcaagaccagcctggccaacatggtgaaaccccgtctctactaaaaatacaaaaaattagccagtcatggtgacatgcacctgtaatcccagctactcaggaggctgaggcaggagaattgcttgaactcgggaagtggagggtacagagagctgagattgtaccactgcactctgacctaggtgacagagtgagactctgtctcaaaaaaaaaaaaaaagtcgtatgtatttatgaagtatatgtgatattttgataaaatcgtatgatgtgtaatgatctgatcaaaataattaagatatccatcagctcaaggatttatcatttctttgtgtttggaacattccaaatccactcctctagttattttggaatacacaatatattttttttagttccaagtatgagtgaaaatatacaatatctgtctttctgtgcttggcttatttcacttaacataatatccttcagttttattcatatcgttgcaaatgacaggatttcattttttcatggctgaatagtattctattatgtatctattattaaaaataatggcaaaaacagcaattacttttgcaccaatctaatataccacattttctctttccattcattgatgaaaagttaagttgattccatatcatggctattgtgaatagtgctacaataaacatgggattgcagatattccttcaatatactagtttccttttttaaaatatatatctagcactgggcttgctggaatttctattttagttttttgaggaacctccatactgttttctagcagctgtactaatttacattccagcagttcatgagtgtttcctttgttctgcatcctcatcagcatctattactttttgtatttttcataaaagctattttaactgaggtaacatgatatctcattgtggctttaatttacatttctttgatgattagtgattctgagcatttttttaatatacttgttgatgatttgtatgtttgtcattgagaaatgtctgttcaggtcttttgcacatttaaaaatggtattatttgtttttctattgaggtatttgagtttcttatatattctggttcctaatttcttctcagttgaatattctacaaatatttcctcctatttttacctttgctgtgcagaagatttttttcattggtgtgatcccatttatggatttttttttctttgattgcctgtgcttttgtggtcttattccagaaatctttgataagacaaaagtccttaagtttttccacaatgttttctaatggtagtttcataatttaggtcttacatataagtctttaattaatttttatttgattttttatatggtgagagatagaggtctagtttcattcttctccataatggatatccagtttccctagaaccatttgttatatggtcatttcttgtcaaacttgtcatttccccaatgtatgttcctggcacctttgttgaaaatgaactggttgcaaacatgtggatttatttcatggttctctattctgttccattcgtctatgtgtctgttcttatgacagcacaatactgttttggtaactataaatttgcagtataacttgaagtcaggtaatgtaattcctcaagttttgttctttttgctcagaattactttggctatttgggatcttctgtgattccatacaacttttaggacttaaacaaattttctatgaagaatatcattggtattttgatgggaattgcattgaatctgtagagtgcttggggtagaatagacattttaacaatattaattcttccaggccatgaacatgaaatatcttcccatttttggtgtcctcttcagtttctttcatcaatatagagatctcttgcttctttggttaagtttattcctgggtattttattttatttgttgctattataaatgggattgctctcttgatttccttttcagatgtttactgttggcatataggaatgctattgatttttgtatgttgattttgtattgtccaactttattgaactcatttatcagttttaacagtttttcatttttagtggagtctttaggttttctaaatataagatcatatcgtttacaaacaagaataatttgacttctttctaatttggatatgctttatttctttctcttgtctaactactctggctatgaattccagtactatgttgaataaaaatggtgaaaatgggcatccttgtcttgttccagatcttacagaaaaggctgtcagtttttcccattcagtatgatactgtaggtttgttacatatcgcctttattggattgaggtatatttcttttatatccagtttgataacagtttttaatcatgacatgacattgaattttaccaaatgcttttttagcatcttctgaaatagtcatctattttttgtctttcattctgttgatgtaatgtttcatgtttatggatttgatgtgaatctcacctgatcatgatgagtgatctttttaatgtgttgttgaatttggcatgctagtatttgttgaggattattttcatctatattaatcaatattggtctgcagtttttaattttttttcttgtggtagtgtctctgcctggttttggtatcagggtaatgctggccctagagaatgagtttgaaagtattccctcttcctaatattttcagaatagtatgagtaggattggtgttagcttttctttaaatgtttggtagaattaagcattgaaaccatcaagtcctgggctcttctttgatgggagagtttttattactggctctatacattacataatattgggctatttaggttttctatttctttatggttcaatattaggaggttgtatgtattcaagaatttatccttttcttctaggttttcaaatttattggcttatagttgcacaatagtagtctctaatgatcctttaaatttttgagctatcaattgtaatatctaatttttcaactctgattttatttatttatattttctctcctttcttctttggctaaagatttgtcaagtttggttgtcttttcaaaaaagcaactttttattgtattgatcttttgatgtagatctttattgttataaacttccctcttagtcctgcttttgctgtatcccacaaaggtttttaaaaataagacaataatgaagtttaccacatcaattaactcttcttttcacaaaagatttcactgtagcatgcaatgctatttgatagcattttacccacagtagaatgtctttcaaagttgaagtcaatactctcaaaccctgctgctgctttatcagctaagtttatataatattctatattgtttattattatttcaacaatgttcacagtatcttgcccagaagtagattcaatttaaataaaccactttctttgttcatgcataagaagcagctcctcaacattaaagtttgattatgagattgcagcaattcagtcacatcttcaggctccacattcttgttcttttgctatttccactacaactgcagttacttccttcactgaagttttgaacccctcaaagtcatctatgatgttcttaatgctatctaaaatggtgaatcttttccagaagattctcaatttacttttcccagatccatcagaggaatcactatggcagctattgccttacaaaataaatttctgaaataataagacttgaaagtctaacttactctttgatccctgggctgcagaatgaatgttgtgtcttgtgtcagcagacatgaaaacaacattaatctcatatatctctatcagagctcttgggttactaggtgcattgccaatgagcagtgatattttgaaaggaatcttattttctgaacagtgagtcttaacaatggatttaaaatattcattaaaccatgccatgaacaaatgtgtcatcatccatgctgtgttgttcattttatagggcactggcagaatagacagcataatttttaagggccctaggatttttggaataacaaatgagcactggcttaacttcaagtcaccagctgcactaacccttagtaacagagtctgcctgtcatttgaagatttgaagtcaggcattgacttctcctctctagctatgaaagtcctagatggaatctttttacaatgtaagactgttttgtctacattgaaaatctgttctttaatatagccacctcatcaatgatcttaactaggtcctttagataacttgctgcagcttttcaacacttgctgctttgccttgcacttttatgttatggagatggcttctttccttatacctcaggaaccaaactctgctggccacaagttttcttctgcagcttcttcaactctttgagcttttatagcattgaaaagagctagatccttgacacgtattaggctttggcttaaggaaatgttgtggcttgtttgatcttgtatccagaccacttaaactctatatcagcaataaggctgctttgtttgcttaccatttggtgttcactggagtagcacttttaatttccattaataactcttactttccattcagaacttggctgtttggtgcaagaggcctagctttcagcctgtgttgggttttgatatgtcttcctcactaagcttaatcatttctagcttaactcactcaaatagcgagtgacattgtgactctttcatttcaacacttagaggacattgtatggttattaattggcttaatttcaacattgttatatgttaggaaatagggagtctcaaggagaggaagagagtcaggagcacatggagcagtcagaacatatacatttgctgatgaacttcactttcttacatgggcatggttcgtgaagctccaaaacaattaccagagtaacatcaatgatctctgatcataggtcaccagaacagatataataataataaaaagttaaaaatatggtgactattgccaaaatgtgacacgaaaaaatgaagtgacacatgctaccagcaaaatggcaccaatagttttgctcgatgcaggattgtcacaaacctttaatttgtaaaaagcacaatatctgcaaggtgtaataaagcatagtgagataaaatgatgtatgcctgtatgtgttaggttgaaattcacctataaataatatttctagtagtcaatgctttatagagataacacagaacactatacataattagctatacatgatactctatttagactgtaagctagatatacttttccaaatgtgtacaactccattcaatttcattttatttcattttttataagagaatgaggttttagatgaaaagggagtggcaaacggtggcttaaacgtggaggagttagaaagaataaaagtgaaagaaactcccaggtaggagcaatagacttattgcagagtagttaataggtaaaggaagtgaaacattttagccttgaaaagaggcagaacacttggaagctttagttaaatatatgaaaggctgtagtgaggaacagatttcaaaaacagtgttagaacactttatgagtaaaaactcagattacacagtttctatgagaaaaatgactcacagctagctatccagagcacaatgaattgtctccagtgctattatgtttttctgttttttttttttctctgttgttggaggtcctcaggaagagtgagtaaccatttattacatgaattaaataactataagctaccagataaactgtggaaatagatggaagtaggctccctcacaactctgagattctagttttcatcagaaggagcttgtcttaaagctgattaatcatagttccaggaccttatgttcataattcaactgatgaggacaagtaaacaaagctacatttttctcttgttttgttttgagatggagtctcgctctgtcaccaggctggagtgcagtggcacaatctcagctcactgcaacctctgcctcccgagttcatgccattctcctgcctcagcctcccaagtagctgagactgcaggcgcacacctccacgcctggctaatttttgtacttttagtagagatggggtttcaccatgttggccagaatggtcttgatctcttgacctcatgatctgcctgcctcggccttccaaagtgctgggattacaggcgtgagccaccgcgcccggcctacatgttttaattggtactgcaaggcattagtttttggcaggcatttttcttaaccaattatggacattaaaattctgtgaaaatagatgtaaattattttatatttatcctcctaaagaatgaatggcttcagaagaaatcttactatacttatataaaaatataggtgtttttcattcatgaaaaatgaacacttttttgagtatcctcattctaaatattattcatatggacataagagttattctaaaatcctccctttttctcacttcctttgcactgttgaagtcttatgcatccaatttctgacatcaccaaatctgttctttccctcttttctatcaatgcttggatcttgaaatgtcctcataatgagtttccctgctgtggctctttccttgctttcttcacaatatctccaaagttgtctttaaaaatattttcctacgtcttcactttctagaagattaactgcaattttgctcatgttttacaacagtgacactagacatcttatctttccccacaaacctactatattgtgggaaatatattaggaaataaggagtctcagtcagagctccaaggaaaatagatgacatgcaagaatgtgcaaactgaagagagtttaatgaagaggacatttacaaagttatcggtagacttcaaggaaattgatgtagaatgaatgttatccaggactagcaatgccagggagtgggtaccccacttcttcaggtgtgaagggtgaaaggatcctagaatctgaaatgaagatatgaagctctaggagatgaacatccaataagagatatgcttacaggttggaggcttagccaatttgcagcactcctgaaaggaaggagtggtagacacgtccgaaagccactctcatcatttcctcccatttcctccatgtgtctcccattaggcaacaccaagaaaaggccaaagagcaagggaccctattggtgcaatccacacaggtatttagcctgagtggaggggagggggcagagaaaagaaagaaatgataaggagtagatctgaaccgaaaaatcgaaattatccctcttgctcataccttttatttatataattggcaaatttctacccatgctttaatttccactcagatacagaataatcactctgaattatttcctttctattcttccatagctagttttttgcacactcagtgcttcaaagatattgtgcttagactttgatttcacctcattgttctaaatgagctacgagaggaaaaagatactgatttattcttctctgtgttctgtagcactcaccttgcagcttctggctcacaggagtcaatataattgttaagcagtgaatgcaaataattgtttaacatttgtacagatagatgaataattgttcacaaatgaggacttcagcatgtatatagattttaaaataagtagttttcttaactttgctaaatagaaataacaaacataacactatcataacgttaaaattacactacataacacaatatattcaaagagctagataatgtcagatgcagtagacagtcaacctaagttatcctaacctatattaaatataatagtgaaattaacacaggaagaaaaacagctatagagacaagatgcagacaaagacaaacaaatatagtgtgttaaaagtggttcttcagaataaagaatccagaaataagactacacatctaagactatctgatcttagacaaacctgataaaaacaagcagtggggaaaggattctctatttcataaatggtgctgggataactggttagccatatgcagaaaattgaaactggaccccttccttacaccatatacaaaaattaatcaagatggattaaagacttaaatgcaaaaccccataaaaaccctggaagacaatctaggcaataccattcaagacataggcacgggcaaagattttatgacaaagtttccaaaagcaattgcagcgaaagcaaaaatagacaaaagggatcatattaaactaaagagattcttcacagcaaaagaaactatcaagagtaaacagccaacctacagaatgggagaatatttttgcaatctatgcatctgacaaatgtctagtatccagcatctataaagaacttaacaaatttacaagaaaaaaataagcaaccccattaaaaagtggacaaaggacgagaacagacatttctcaaaagaagacatacatgtggccaacaaacatatgagaaaaactcaacatcactgatcattagagaaatgcatatcaaaaccacaatgagataccgtctcacaccagtcagaatgtctattattaaaaagtcaaaaagcaacagatgctggtgaggttgtggagaaaaaggaacacttttacactgttggtaggagtataaattatttcaatcattgtggaagacggtgtggtgattcctcaaagatgtagaagtggaaatactattcgacccagcaatcccattactgatatatacccaaaggaatataaatcattctattataaggacacatgcatgtgtatgtttattgcagcactattcacaaaaacaaagacatataatcaacctaatgcccatcagcaatagactagataaagaaaatgtggtacatataccacggaatactatgcagccctaaaaaggaatgagattatgtcctttgcagggacataaattgagttggaggctattatccttagcaaactaatgcaggaacagaaaaccaaatactgcatgctcttatttagaagtgggagctaaatgatgagaacacttggacacataagggagaacaacacacactggggccttttggagtgtggagggtgggaggaagaagagcatcatgaaggataactaatggatgctgggcttaatacctaggtgatgaaacgatctgtttggcaaaccaccatggtacaagtttacctatgtaacaaacctgtacatcctgcacatgtacccttgatcataaaataaaagctggaaataagaaaaaagaaaaaaggtggttcttaggtagttgtgagtggcatagaaagaaaaaaaaaagcatatgccaaattctgatatgaggattaaataaaactttggatattgtccctagcttttcaacagaaacctgtttcatcaaggtaatgtagcataggttatctttcttctaaatctctccgtttaaaacagttttgttgaatggagagtaatgagatcttctgtgcaacttgaataatggcaactagtgctcagtgattcaaggattaaatggaaatattcagtgtgactcttggagactttgtaaattcattggatgtactaggaattcattcctttcagttatgtctgatgttgatctacactgtatcaattttttttatcagttaaatagtagcttgtggcagtgccagtgtattctctttaaatttgcaaagatgatggtggccaacaagcatgaggatttccaaatcttaagggtatgtaagttgtgaagatggaaatatctatttagttgtgcaagtggaataaagcaagtattagataacttcaaaattcagataacaaagatgagaatcagaaacttttccatagttggcttttctttttaattgtattttcatcttattaaaattgatttaagcacaaactattaagttactttttaaaactttaaaaatcacctccattcatttattcattcatttatccatacaacaaatatgcattgagtgccaaataaatgaaagcattattctagaatgtgtgactataaaggtacacaaaatagatagcagtgggtactacgcagaaagataaaacagattaagtggatagaaaatgatgtgagtctgctgttttagagtggtcagttcatgcatgagatacacttagaaaataaaaggtagttgctttttttttttttaacagctgcttctctgtcctcacaccacatctataagattattttattttaataatcttttctctttgagggccataagtcttctcagtctttctgagctcatgggaggcaaatgacttattagtaatataatctgacttcaaaaagcaagtattttccagttctgtcattttcatgtctcaccactgaagaaaatcagggatgccagaaagttcacaccaaattattaattttctgtatggtggatttcagttccattaatttaagaacattattatgattactctataaatttcataaagtgctaactgacatcctctatgttgcattactgtgtaaatacaggaaattaaagtttttagttctggaggccctaactatgcccatttgcattgctttcttataggtaaaagccaatcataatcctgaatttatattcttctcttcgaaaacagtaaaatggaagtcatactttctgagtagaactgtgtgtatttctttgagatgacagtgtggcgtataaataatggctgttatggttaccttaatagcagcatatttcaaacctcaggactggaattgttaggtggtgaaagtattctgaggggatcatcatatctgattcctataaaccataactccaaataaatatttgaagtagtagtagtacttttggttttcctgaaacgggtgcaaagagctcccacatcagatgtcctttcattctcaggttttatatgcattgaaaagacatctcaataacaaccctttgtggagtaattgctgactttgaggaagctgggggagaggagatggtatgaatccttttaattgagctctacttgttttatgagacaccccctttaaaataactccctttaaagttttagtttgaggatacaaatttaaatttatgtaataacattccataatataatggtgactgtagataactgcagggaaaggtaagtagaatgatggtttgtaatgaaagctctccattggcagataaataaaagattggatatcaattatctctaacaaaaggtacactggaactacatagaatgcagaagctggggcagactaacaatacaagctctattatatatatatttttaaatatggagtagtttggtgtgataaacccttaaatcccattcaatgagaagctgtattattatattgctaagtaattatgtttctttatagtactcttaaatcctctaattgaaagcacttgttatgcctcaaattatactgtcagactgtgctcaagctatgtgcagtacttgagaacagataaaagtagagtgcttttgagggtttcatcacccatttgatgaaacatatgggatgtttcatcatatgggtgacgtttacataaacaataaaaaaagcccatatgagcttgggtactttttattgttagcaagtagaactaaccaattgaagcagcagtcacacctacagaacagaaagaaaatggtgcttagtctgtagaaatttttattctattgagataaggaggaatgtttaagcttgtttggagaaaaaaaatctgagcagacctagtaaaaatcaaacaacatgtattataatagaaaccagtatggaaatttgctctggtaacaatccattagaaagtttccagattaagtgatatatatatatatatatacatacatacacacacacacacacacatatatatatacacatatatatacatatatatacacatatatatatcacttaatatatatatttctcattattgtcaagtgaaaatgcaataagaactatatacagaatattttctcatttgtaccctaacagatagctaagaatagaaatctgtacagaaggctactttttcaggtctcatcatcatttacctaagtcatctatcacctgaaattactgttgacaactatagattttctggttttgttttctcaccatgaggatcttttaaactctctataataagccatttcatctatgttctcacttaatagggtaatagggctattaggaaattgaacattattttgatagctatgtttctacatctacctctttgataacagcattcacattttttcaaaagaaaactctaattataggagtagttttatttctgttaagttattttttctctaagctttctctttcttccttatattttttttctattttaataggtttgctttctcttgctaagataaactattttattgaaaatagagcataatattcttccttttaaaatattacactcaacagatttgcttgttttctttaaactggtaaaataggatatttaaaaaaatatttaccaaattcaagataaaatgtcactttagttattcagaggcagtcaaatcacatacagtattccacacaccccaacaaatacaaagtcacattcctacgtgttatgaaggatctctcaattccactcactttttgatgctaaaaactgtatctcaaaatatagtgtctctctctcacggcctaaatataacatcagaaatttattagatatatccttcttgttttgtcataacatctctcatttataattcatttgaaatcatagatcataaaatttgtagcttaatggaccttatataacggcataggtatattaaaagtaaaatggtagaaaaagatctaccatgtacatcaaggcaaagaaaattaccagagattctttatcttgtttaatgcttaaaggatcaatttaccaagaagacgaaataatcctaaatgcacataataacggtgcttcaaaatacgtgaatcaaaaattgactgaaataaatggtcagatccacaaattcacaattataattttgcatttcataatctttttagaacttataaaattagtagatagaaaatcagtgagaacatagaaaaactaaataactccaccaatgaactgcatctaactgacatttatggagcactgagtcaaacaagagcagaatatatacttttcaagtacaaataggcatttaccaagatgacccatattctagaatagaaaacaaaattttaaaagtgcaaaaaattaaaacaaatatatattcttagataataatggaattaaactggaaatcaataacaggaaagagaaaaatttccaaacttggaaattacacaaaacactcttaaataattcatgtattcatgtttattagttttatttggtgtgtaataacttgtcatcaacttagtagcttaatactttaaaaattaattattattattcacccactcttattctggtctgtaaaacaacaccttttaaattcttgtcattattatttttagagatggaatctttctctcttggccaggctgtagtgcattgtgcagtcatggcttatggccacctcaaactcctaggctcaagtgatccttccacctcagcctcccatgtagctgggtgtattagtctgttctcacactgctataaagatactacccaagagtggataatttaaaaacaaagtaggtttaattgactcacagttccacatggttggggaggactcaggaaacttacaattatggtagaagagaagcaggcacatcttacatggcagcaggcaagagagactgagcaagagtggggaaaactgccttataaaaccatcagatcttgtgagaactcactcactatcacgagaacagcatgggagaaaccacccccatgattcaatcacctcctacctggtccctccctcgacacatagggattatggggattacaatttgaggtgagatttgggtggggacacagagccaaaccgtatcactggagctacaggtgtgagccgtcacatcctgcaaaaacagttaatatctgacagtttctgagtcagtaatgaggacaacttagctgggtcctctcttaggatctcataaggtgctgtcaagatgttggctgggctgttttctcatctggaggctggactggagaaggatccatttccatctctctaaggttatgggagattgttgtgtgtgtggctgtagaattcatgttaacttgattttttaaagccagcaacgaagaaagagaaaatctagagctaaccgatagtgagatggaactttagataacataattcaatcaccgaagtgacatctcatcacatatgccacgttttattggttagatgcaaatcataggtccagtctttactcaatgggaggctaatataaaggtaatgaagatgaggaggcagaaatcctaagaatcatcataaaatttgtctaccacacaatggatcaaagaaaaagtctacagaaatctagaaaatattttgaacagaatgaaaatgtaaatacaaaattaaaaaacctgtgggattcaactaaaacagtacttgtatgtaaatttacagaattaaatgcttacataaaatatttaaaagttctcaaataagtaatctaagtttccatctgtgaaaactagaaaaaataaggacaaaatgcacccaaagcaagaaaaagaaaggaaattaaataagagaggaaatcaatacaagtcaaagtgaagtgacaatagaaagaaaatcagtgaatccaaaaaataaccttttggaaagcttgctaaaattgataacgcactagaaagactgaccaaaaaaaaaaaaaaaaaaaaaaaaagagagagagaagacaaaaataagcaaaatcttaaaaaataagtgatactactacagagaaacaggcattcaaaaagagtataatactacacacatatataaatagataaaatagaccagtttcttaatatgtgcaaactacaaaactctacccaaaatgagttctatatttactaaatttccaaaatatgaatctctagtacctcatggtttcacaggtgaattatgtcagatatttaaagaaaaataacaccagtgctacaaaatcctacataattgaaaagtagagaacactttataattcatgacaggaagtgggggaggagagatgggagaagagagagaaggagagagagagagagagaaatgaggagagagagagaggagagccagacagaaatacatcatccaaaaatggtatttgtttacataatttgagaccggttttaatattaaaatttcaatcaatttaacccaaaaaccaatttaaatatattaattgataacagaaaaaaaatttgatgaagttcaacgtcaatttaatataaactctcagcacattcaaatagaagacaatgtcctaaatctgatacagagaaatctacaaataacctaaaactaacattctgttgaaagacaaaaaaactgtatatttttgctgtgatcaaaacaatcaaggatgtccactcttaccacttctatttaacattgtgctaaaagtgcagtaagtcataaaaaagaatggataggcatacagattcaaaagaaatttaataatgtctctattcatacaatagaagattgtctatgtagatgatcccaataaatctccaaaaatccccacatagacctaataaatgagtttgacaaggatgcagaatacaggttcaagtgacaaaatcaatggtatttttatttatcagcaatgaacaatttgaaactaaattttaaaaagctaccactaatactaggtcaaaaataaaataggcatgtagctatcaaaacatgcagaatctacatgatgaaaactgcaaaatactgataaaaaaataaagaccgaaataggtgataaaaaggcatcctatgttcacagtttgaaggattcagcatagtaaagatgttgataatatcctaactgatctacatatttaatgcaattacattaaaaactccagtaagatttctttatagatacataaaagctcgttctaaaatatctattaaggctggatgtggtggctcatgcatctgtaatcccagcactttggggggctgaggtgggagggtcacttgaggccaggagctcaagaccagcctggccaacatagcaaaaaacctgtctctatgaaaaatataaaaaattagcctagtgtgttggtgaacacctgcagtcctaggagaattgcttgaacctgggaggtggaggttgcagtgaaccgagattgcaccactgtactccagcctggtgacagagcaaggctccatctcaaaattaaataaataaataaataaataaataaataaataaataaataaaatgtatattaactagtttaaaagcggaataggaaaaataactttacaaaagaagactgaagttgggggaatcactctatcacatttaagaacttctgtgcagcagtaatcaatacagtatggatttggtaaagacatagatcaatgaaacaggatttggagtctagaaacagatgtacataaacgtggcccactgatttttgtcaatggtataaaggcagttaagtgaatagttgatagtattttcaacaaatattttaaaacaattggatatttgtatgccaaaaatattttacattgagttcaagctaagacttaaaaaaattaactcaaaatgtatcatacatctaaaagtaaaacattaaaacaacaaaatatttagaagaaaacctaggaggaaatctttgtaacctggacataggcaaatatttctgggacatgacaataaaaagttcatatgagcaaaaatgttgataaattaatctttatcaaaatttaaaaactttgctctgcacaatgccttgtgaaaagagtagaaaaataagccacagtctgggagatatttgcaaatcacatacctgacaaagtactcatatgcagaatatataaagaactttaaacacttcacaatagagtatactctcagaaagatggtgtgaggaactccaaatatcttctcccccaaaaccgaaaaagaaaaaataatcaaaattaactattgaaagtctctgaaaattaaacaaaggccatataagttaacaagtattcattaagggtagttaatctctgtaagagcaagaagattccatgtctacctctcccttccccaggtccacagtgtgaaagttctgccctgtgtgggtggggacatctatgagaactactagctctgctgccgtattggagggggctgactttgtttagtgaaaagaatggataaactcttacctagggtatttgttgaaaataatagagatctcatctcagttgttaaaacaatcagtggttaaaacatagcagtgttagttggagaaagcaacaaatctgcagtctagttataaatttaacaggatgattcaggggaagagacagtcaagtaaggctctgtttgaatccctgctgatctgcaaggctgatgcatgcacagggctgtgccacttagaaaagacaggaaaaagtcttaagagatactagaccctggatgaatgtgaggcagacttgtaaaccttctgaattttataagcattcccatgacacagatccaatggcaaatagtagagtcttactagttcaagttatttaatcacaaccgctgaccagttattggctgattgaacaaccactaactaagctgactcagagataaacctttagaaaccagtcttaaaaataaacacaagaaaaaaactgagcaatggtaccatagaccacaaactgtcaaacaaacactccataaaattagtacacacaagtcactaaataaataaacaacaaacaagaaatgataacagtaaaccccaaggtggagtggaaaaaatagaattcatagttgttacattcaattatataaaatgtctgatttttgatagaaaattataacacatgaaagaggaaaacataacccatatgcagagataaatgcagtcattagaaattatttttgagaggtcctagaagttggacttagcagagagagatttcaatgcagccaccattaatacgtttagagaactaaagaaaagctttttaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatgtccttgatgaacactgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaataacccctcatgctaaaaactctcaataaattacgtattgatgggacgtatctcaaaataataagagctatctatgacaaatccacagccaatatcatgctgaatgggcaaaaactggaagcattccctttgaaaactggcacaagacagggatgccctctctcaacactcctattcaacatagtgttggaagttctggccagggcaattaggcaggagaaggaaataaagggtattcagttaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttataagggacgtgaaggacctcttcaaggagaactacaaaccactcctcaatgaaataaaagaggatacaaacaaatggaagaacattccatgctcatgtataggaagaatcaatatcgtgaaaatggccatactgcccaaggtaatttatagattcaatgccatccccatcaagctaccaatgactttcttcacagaattagaaaaaactactttaaagttcatatggaaccaaaaaagagcccgcatcgccaagtcagtcctaagccaaaagaacaaagctggaggcatcacgctacctgacttcaaactatactacaaggctacagtaaccaaaacagcacggtactggtaccaaaacagagatatagatcaatggaacagaacagagccctcagaaataatgccgcatatctacaaatatctgatctttgacaaacttgagaaaaacaagaaatggggaaaggattccctatttaatcaatggtgctgggaaaactggctagccatatgtagaaagctgaaactggatcccttccttacaccctatacaacaatcaattcaagatggattaaagacttaaacgttagatctaaaaccataaaaaccctagaagaaaacctacgcattgccattcaggacactggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtggaactgtaaactatttcaatcattgtggaaggcagtgtggcgattcctcagggatctagaactagaaataccatttgacccagccatcccattactgggtatatacccaaaggactataaatcatgctgctataaaaacacatgcacgcgtatgtttattgcggcactattcacaatagcaaagacttggaaccaacacaaatgtccaacaacgatagactggattaagaaaatgtggcacatatacaccatggaatactatgcagccataaaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatgggcacaggaaggggaacatcacactctggggactgttgtggggtcgggggaggggggcgggatagcattgggagatatacctaatgctagatgacgagttagtgggtgcagcgcaccagcatgtcacatgtatacatatgtaactaacctgcacattgtgcacatgtaccctaaaacttaaagtataataattgaaaaaaagaaaagctttttaaaaattaatagtaaaccaataatgcaatgattcatcaaatacagactatcaaagatatagaaattacaaaaagaattacttggaaattctgcaactgaaaagtataacaacaacaacaacaacaacaataaaacctctaaatatttttaagttagcagaagaaagcatcaaggaatttaaaggtagaacaatagagatttttcaatctgaaaacaggaaaaaaatttaacaaggaaaaattaaagacaaatgaacaaagcctaagagatttgtgagactctattaaatatacaagcatatgcatgatgggagtcccagaagaagaggaaaaagaagggaacaaaaatatttttagaaaataatgactgaaaactccctaaatttgatgaagcacattaatccacaaatatcaaaagctcaacaaactgaaattatgataaatgcaaagatctgcacctaggcacatcataagtgcagtggtgaaagtgaaagaaaaagtaaacaacacaaaacaaaatatccttgcagttgacaagagaaaaataattaattgcacacaagagagccataatgaaattaacagatggcttttcattgaaaataatgaaatccaaaagaaaaaggcaatgggatggaatattaaaagtgtaaaagagaaaattgtcaacatgtctttcaaaaacaagttgaaataaattgcaagacaaacgagacaatgcgttatgattaaacctgccttaagtatatactaaaggatgttcttcaggcagaaagaaagcaacatcaaatggttcctcaaatccacatgaagatataaattaaactccaaatacacaagtatgtggaatgtaaaacaacagaaaagctttgaatgtaaaacacaccatgcaaacattaaatgagagtaaatgagtaaaaatacaagaaatgaagtggcaacattaatattagacaaaatagtctttaagacaaaaagttactagagacaaactaggaactcattagaaagagatacagacacaaacatatatgcatctaacaagagaccttcaatatacgtcaatatgcatgaagcaaaaacagaacaaaagggaaatagacaattcaataagaatagttatagacgtcaataaaccacttttactaatagaagaattagaaaatcagcaagagtgtaagagatgtgaacaccattcacctattagccctgtaatttatagaatactcaatctaatagcaccaaaatacatattcttgtcaagggaatatggaatattctccaggataggcttgtctaggctataaaataagtatcaacatttttaatagacaaagatgtatttattctgaagagaaactacaaaaataacaactgtgtgaggtaatgcatttgttgattaactatatttaaccattctacagggtatatagaattatgttgcacatgataggtacatacaattttataatgtcaactaaaaaattatgtcacacgcaataggtagatacaattttataatgtcaactaaaaaataaatttgaaaatttgacagtatcaattgctggttagaatttggaacaagcgcaactctcacacattgctgttatgaatacaaaatggtagtgcagtttcttataaagttaaatatatgttttctatacaacccaacaatctcactcctattttcttgccctagagaaatgaaaacttctgttcacacaaaaaacccatacatgaacactcatagcagttctattcattgcacaaaactagaaacaacccaaatgtcctttgtaaacaaactgtggagcagccatacagtggaataccctcagggatagaaagaaacaaactcttgatacacggattaacttgggtaatctcagagatgttgtggtcagtgaaagtagtagccagtcttaaaggttacatgttgaataattatattaatatgacattttcccaaaaagatcagcctgcagtggtagcaggtagatcagttattcccaggttttaggtcaggaagaggctgtgaatacaaataagagcataaaggctttcctttgtgatgatgaaattgttctgtgtcctggctgtggtggttgttaaatgaactatccatgcattaaaaatcttaaatctgtatgttggcagcaggccccccaaaatctggccataaactggaccccaaactggccataaacaaaatctctgcagcactgtaacatattcataatggccctaatgcccaagctggaaggttgtgggtttacgggaatgagggcaaggaacacccggcctgcccagggcggaaaactgcttaaaggcattcttaagccacaaacaatagcatgagcgatctgtgccttaaggacatgctcctgctacagttaactagcccaacctattcctttaatttggtccatcccttcgtttcccataagggacagttttaattaattgaatatctatagaaacaatgctaatgactggcttgctgttaataaatatgtgcgtaaatctctgtttggggctctcagctctgaaggctgtgagacccctgatttcccacttcacacctctatatttctgtgtgtgtgtgtctttaattcctctaggaacctgggttagggtctcctggaccgagctggtcccagcatctgtacatcaatcaaaataaattttactgtgtgtgaatgtaaaaatgacattatgtgattggaatacatgattcattaccatgaaatcaaatttgtgatttcttatattagacattcttgattttaaaatgtttacgtaaaaaggtttaccatgtaaacactaatcagaagaaaagatttgctatataaatatcataaaaattagacttaaagacatgtattattaaatataaagaaggacatttgataatgataaaagggatcagttcacaggaagacataacaatcctagattttaattaacattgcttcaagttgtacagtgcaaacttgacagaattaagatgagaaataatccacagtcatagttgcactataacataccactctcagtagccaataaaacaggaaggcaaaacaacaataataatgaaacttagttaagataaagaagatttgaacaacatgattaaccaactttctgtaattaagaggagcgtttcatcaccatcacgtcagataatggcaacaattctatttattttgacatgttatgtgtacatgtgttgctaaaatgtttttccttaaacattaacaaatccaatcagtggaaccacatccagatagcaaataaatagaaaatactgtgtcattagatattgtctattatataactccagtgactcacaggaatgaatacatatagtaaacctcagtgtgagttctgaggggccaggttactgctaagggagagtcattgcccaggcttctatgagtaaatcaccaatggaataacatattaatgagaaagcatgtgaatattcaggttattgtacaaaatgcaacagtggattactctcatcctgctttacaaataagttacatttcccttctcattattaaatgtatacttttgaaatacagaagaatatacataagaaaatacaaattctccacaatactgccactaaaggacagaattgctaaatatcctggttcatttttcatttcctttcacaattttattttgcatatgcaaatatatatgcatacattatatcattatggtttttatctgtaatctctacaacttgttaatattttactgtatgtccttttgcatatcaatatcctgaaaacattattttatatcactgattaatgtatattctaagacatagaagtctattttgaaactgtattgttaaaaatttgcaaacaataaaatatttctttgcatctttattttttatgggcagacacacagaggtgaagctgctgtgtcaaaaggaattagtaatttcagtgtactaattgccaaaataatttctcaaatggttgttctgatttctatttcctccagcagaaaattagaatgctcacttctctgactttcttcatcattgcattaccataaaatatgattgcctatttttaggtaaatgtgcatttctttaattattgtaaaaatgttttgtctatgtaaccattttatttttctaaaattgtcatcttttgcatatttgtattgatattttcatattgattcataagaactaattttaaggtaaaatattaattctgtctttcatttaatcataaatacttaaaggtttgctttatcatctaattatgcttaatataatgctttagttatatagtcttatatagtcagattaatcaatgtttttccctgtattctgatactcttgtgtttagagatttttttcccaggtaaaatgaagaccttaatgataatatttttgttttttatgattttattgctacagtttattctgtgagatatttatgttagtgctcagtgcaaagtaggattctaactttatttccaaataattagctaaattccaaatttcgtattttgggaaattatacttttcttattggtttgtagtactttctttgtaattatctcatattataaccaagtagtttaggttcaaaacacattaaaaatttttttctttcttttttctcctttcctcctagtctcaagacttgaagcaaatttcagaagcctttttttccctccttagtcttaaaatatagcttgaagtgtactttttaaaactctacatccctccctttcccaccatacacttccttacactatgcacatttatctaactgtatgcttgtgaagcttacaccatgcacacttatctatgtgcttacttgggagttccagggactaatcttgagacacaccaagcatggagacccagttgcaaaattctgaagattacttcatggtagttagtcaacaacccagccattgttgagacaatgccagcctgagttccaggtggactgcaactcaagatagccaccggaataagacacacagactttgtacccagcacaattcccacatgcttcccgtaccaagttccgttttttagcccctctccccaacctaaagtttgaaatggtttctttaaggcactaaccttggccatttccctatggctgactctagattaaagtcactttccttctgctgtgcttcttccttgtttaccagctttatacatagcaagcagacaaccttgcttttgattataatatatgaaagaagttcatgtgtaatgaacttggtattaaaatgtttatgtaaaaaggtgtttaccttgtaaacactaaccagaataaaagatttgctatataaatatcataaaaattagtctttaaggcatgtattattaaatatagagagagacatttgataatgatgaaagggatcaattcacaggaagacataatcctagatttgaacttcttacatatttacatataattattgatatcaacaatcaatttgactgcagattcttgttcatattccaaatgttttcatttattgtaatgttatagtattttcctatctcattggacaattttcttcattattattttttattagtagtaaatatttcttggttaatctcagtagcttataatcagaaaacttttagacaattaataatttaagttccatcaaacttctactatggttttgttggaattacagtgaaactaaaaataactggtatacttttaccgtttaatcttttcagtatgtgttttctattttctagtacgtttgactttggacaacatgagtttgaactacacaggtccacttatacgcggattgttttcagtaaaattacaccaagtgtgtctgtctctcctgtttctccttccacctcctccacttcaccctttgctatcccttagacagcaagatcaacccctctttcttcctcctccttctcagcctactcaacaagatgatgagaataaagacctgtatgatgatccactttcacttaatgaatagtatattttctcttccttatgattttcttaataatatgttcttttctctagcttactttatcataagaatacagtatataatacatataacatacaaaatatgtgttgactgtttatattattagtaaggcttccagtgaagtaaatagtaaagtttcgtggggttcaaaattatacacaattatttttactgtgcagggctcagtgcccctaagtcctgcattgctcaagggtcaacagaatatagatatgtctctctctctgtgtgtgtgtgtgtgtgtgtgtgtgtgtgtgtaaagtttacttcatatagttctcacatattatatttgcagataaatattgtttattatgttaagaaatactgtatattgtagttcgccaagaattctatcaggaatgggaattgagttatcacaaattatttcagaatccacttagatgatcatatacttatttttgaaattatgtgttaatagttttcagtatttagccatccacactccttaggttaccttttctgtagctgttttctttctccctttttttcttttctattctatttagaaacctatataattgtatctctgacaaaggtattttcaataagttacaatgtttggtaaatagaatgatctatatcaacgagctaaatagtgtggaagtctgagaaaagagtatctattgattaccaaacttaggcaattaggctgtgatttttttttacatacaggtagtctttgctttgcaaaatggtacttggaaatcaaaatgatcatataaactgagaccatgcaaagtgatctaaataatcactgggaaaaatacaattttcctgtaatctttaacatttttgataaaagatcagaaactcccttactctcagttataaatacatagagaaatgaaaaacagaaaaacatttttgtagaatataattttaaaacattagaaacaatgagaaataaaacattttatttctttgtaaaaaaaaagtatcacaaatagtttgaacagaatttgccttcttcttgccatataagattatgcagagcaagcatcgtttctatgctttgacaaagcattctccttttttctaaatttgaattatcttccaacattttatcctttgcactttcaaagtggtgaactatcttgaagagtttcttttttatttttttatgtgaagatttttgctgatgccactttcctctatgatggcttcacccttttgtcactaccactttcttcctttaggttgataagttcacctttcataattccctcaggctgcgaatctagaatctgaagagtaaaagtatcaacattccctccatcagttattcttccataactgcatttacattggtttcaaattttacttccagcattatcacttctcaattctttttaatttcttcactctactttcatctttgctgaccagcccctctttctttagctatgattattattattattgagacaggttcttgctctgtcacccaggctggtatgcagtggtgcagccatagctcactgtaaccttaaactcctagtctcagttgatcctcccatttctgcctcccaaagcgctgggattacaggtgtgagccactgttccaggtcttgattagccatttttaaaaatggcatgtgagtttaacactggaaagcacttgggcaatacaactatgtgcttttctgtttgtgcatgaactgaatgaacagatcagtaaccaatcagtgacagattttgaaagaaggaatgtgattgctcattgattatgatgttaatctgttatttgtagagtggttcatagactgaaaagctagcagctaagtttatcctttatgcaaacactcacagttaatgtgtgagttaatatgacgtggtaactgaaatgtgagccatgttgttgggggcacttgtgttatttatttatttatttgtttatttatttatttatttatttatttatttatttattttgagacggagtctccttctgttgcccaggctagagtgcagtggcgccatctcggttcactgcaagcttcgcctcccgggttcactccattctcctgcctcagcctccggagtaactgggactacaggcgcccgccaccacgcccggctaattttttgtatttttagtagagatggggtttcaccacgttagccaggatagtctcgatctcctgacctcgtgatccgcccacctcggcctcccaaagtgctgagattgcaggcatgagccactgcgcccagccggcacttgtgttatttaactaaacattggtaactcaaatttgtgtgcagtgagaagtacatgtttagacttgataacttttaatgcaaatatgtatttattctatctttagtataagtattctatttgtgaactaaaactttaaagctagtatctttttgtttccagtgagtcctgtttcactcctcctctttaaaggtttcatcagcacttgctctgtgaatggtgaacggggattgccagtaacttcttatgtaggaaagatattgcattctgttattttaaaagataatattgaattatactactattgtttgattctgaaatactactgtcttcaatatgaaactagattatgtaaacctttgtggaagatatatttaacttataattttaacaagtaaaacattttaagctaatggaatcataattagtagttaaagaaatttgaatgtattttacatcatgtagttagctatgggaaaaaaaaacttttacatattcatttattttgaaggtataaaagtcaatacacatggtactatgacttttaaaaatttacttcatttatacacctgggatttggattaatagtacttatacaatataaatactcaatttcataagtgcctagcatcttttgtttgatttcttcaaaacttttatttatgctcatttgaaaagtctcaaatctttttctccattgatggttcaccttaatttgaaggtgatcattatccatgagattatatagagtatttatatgatttttaaaatttaatattagcaacacaatttatcagaggatattttcttttcttttttttctttttttggtaaaataaagaacattaaaaacacttctggaactgatggactttatgttaagtgaaataagccaggcacagaaaagacaaatttcacatgttcttactcataagtgagaactaaaaatttttaataatgaactcatacagtcaaatgatagttactagaagatgaataacataacagtgtgactatagttagcaataatctattgcatattttaaaataaaataaaagagtggaattgagatgttcctaacacaaagaaaatgacaaagaaattgagtaatgaataccccaattaccctgatttgatcattgcacattgtatgactgtataaaaacatcacatgtaccccccataaatatgtataattattaggtacccataaaattaaaaattaaaaataaacaaaaacacttttgcaacttctgtttttctgttctaacacaataaatacactctcacttgttatgtgttctcatagttaccatgcactctacttattattcattcatttagttgatacacaagtcaaaccttgttttcatggaaattctaacactataggggagagaggcaaaagtaagtattacagatggtccaattacatagtattttaggaggtgatacatgtaataaaaataaagcaattttatataatagtcagggtccagaagcagtatagggaatgaacaacatggctgtttggaggaagaatattttctacagagtgcaaggtcctgaggtggaaacttgcctagtatgctgataaaatgaaggagaacagtgatggcggagcacagtggggaagtggtagtaatagaaaagattacagagtaacaaaggaccagctagtctaaattcttgtaagtcagtgtaaggacttcagtttctaccctgagagagctaaggagccattgaatgatttgtagaggagatatattgtgattccattgctaataggttcactctggctgttgcactgagaacaaacttaagggaaacaggagtaagggtaagaaaaccagttaggtgagtattgtagtaatttaggtgaaaaatgatattggctcggactaaggtagcagcagtaggagtcttaagtgattagattcaacatataatttgaaagtagacatgactagatttgctgatggattggatatgtatgaaagatgagatgagccaaggatgcttcctggagttttgacctgaggctcatattttgacctcagaagatggcagtaggagtacgttttagaggaacgtcaggaactctgttttggatgtgtaaatctgagatgaccctcagacactcagatggcgatgttgaggaggctgtcgtatttaaaactctggattactgacaagggttttaaactagaggtattaattattatatataatttcatggaattacgagccatatctactttgtttatttcagtgtgccccatacctatacaacatctagtacttacaaggtacttgagaaatatctgttgagtgagtgaatacacaaacagcgagtcatgtgctggtaaatgattttaatcacaggtactcctggataaacaacaaaaaacacaactcctgatttgtagtgtttccagatttctgtggtgtaaatacttctcccatgacttaaagctatcaaagtagtatcatcgaatattactttgtattccagttgggaagaaatgtgcacaactgtttccttctaggtggtataaacaggctctagaacacaactgggcccactgttgattagtgatataatcatagacatactttcccttacttacaggagtgtgtaacagataattttaaatagtcttgatacttgggcaggtgtgaaggagaaacatcttatagatgataatacaagctcaaaataatgaacttaagcaaatattaaaatcctgtgtgacatagcacaagaaacactacaaacactgtgctaatttatccctgtagccttcaggcaggcttctattactccaaacaggtgatgtctccttatacaattctgggggaaattattttactgcttacaacatattatgatgttaccaggactctcttgccagaactgtctttacaatttatgtcagacatcaaatgtgtttttaaaatgttgctgtaccaagatcaagtgggcttcatccctgggatgcaaggctggttcaacatacacaaatcaataaacataatccagcgtataaacagaaccaacgacaaaaagcatatgattatctcaatagatgcagaaaaggcctttgacaaaattcaacaacgcttcatgctaaaaactcaataaattaggtattgatgggacgtatctcaaaataataagagctatctatgacaaacccacagccaatatcatactgaatgggcaaaaactggaagcattccctttgaaaactggcacaagacagggatgccctctctcaacactcctattcaacatagtattggaagttctggccagggcaattaggcaggagaaggaaataaagggtattcaattaggaaaagaggaagtcaaattgtccctgtttgcagatgacatgattgtatatctagaaaaccccattgtctcagcccaaaatctcctcaagctgataggcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctacccatgactttcttcacagaattggaataaactactttatagtacatatggaaccaaaaaagagcccgcattgccaagacaatcctaagccaaaagaacaaagctggaggcatcacactacctgacttcgaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggggaaaggattccctatttaatcaatggtgctgggaaaactggctagccatatgtagaaagctgaaactggatcccttccttacaccttatacaaaaattaattcaagatggattaaagacttaaatgttagacctaaaaccataaaaatcctagaagaaaacctaggcaataccattcaggacataggcacgggcaaggacttcatgtctaaaacaccaaaagcaatggcaacaaaagccaaaattgacaaatgggatctaattaaactaaagagcttcagcacagcaaaagaaactaccatcagagtgaataggcaacctacagaatgggagaaaattttcgcaacttactcatctgacaaagggctaatatccagaatctacaatgaactcaaacaaatttacaagaaaaaaacaaacaaccccatcaaaaagtgggcaaaggatatgaacacacacttttcaaaagaagacatttatgcagccaaaagacacatgaaaaaatgctcatcatcactgaccatcagagaaatgcaaatcaaaaccacaatgagataccatctcacaccagttagaatggcgatcattaaaaagtcaggaaacaacaggtgctggagggaatatagagaaataggaacacttttacactgttggtgggactgtaaactagttcaaccattgtggaagtcagtgtggtgatttctcagggatctagaactagaaataccatttgactcagacatcctattactgggtatatacccaaaggattataaatcatgctgctataaacacacatgcacatgtatgtttattgcggcactattcacaatagcaaagacttggaaccaacccaaatgtcaaacaatgatggactggattaagaaaatgtggcacatatacaccatggaatactatgcagccataaattatgatgagttcatgttccttgtagggacatggatgaagctggaaaccatcattctcagcaaactatcacaaggacaaaaaaccaaacatcacatgttctcactcataggtgggaattgaacaatgagaacacatggacacaggaaggggaacatcacacactgggacctgttgtggggtggggggaggggggagggatagcattaggagatatacctaatgttaaaagacaagttaatgggtgcagcacaccaacatggcacatgtatacatatgtaacaaacctgcgcgttgtgcacatgtaccctaaaagttaaagtataataaaaaataataaaataaaataaaatgttgctgtaaaaaatatacctcaaaagtatttaaacaaagtttaatcaatttgtcctattttggagtccacattgttttgcatgtatctcagagtcattatattttaaaagtgttcattttaattaattttgtttttaaaatttattgtggtaaaatatatataacataaagtttgccattttaaccattgtaagtgtacagttcaatggcaataagtacatttacactattgtacaaccataccaccactcatctcagaactttaataattatttgacattatttggttttgtgtgaaagaatagcattttgttgtagatgatgaaaaaaagaaaactataaaagaaaataaaattatccaaagtctcaacattcagagaaaattcaatccatattcacctcatggcacatataaaactatatcggactgttaaatccatggtctaaaaatttctcatgtgttaaaaatcctgctgagtctagaattagattaagaatctgactgtgtctaatgaagtggtggagctgcaaaccccagttgtctaatctgcagcatttatttaatataccaatgaggaaacctcaataaaaatgatttatgctcagagtgatgaggcatagggaagaaagggtatgcacaatttctcatgctggacatttgatttagaactgaaccctatgatgagagaactgcaagtagaagatgaaggaactttgggtattaagaaattggtaatacatggccggccgtggtggctcacgcctgtaatcccagcactttgggaggctgaggtgggcggatcacgaggtcaggagatcgagaccatcctggctaacacagtgaaaccccatctctactacaaaatacaaaaaaaatttagcagggcgtggtagcaggcgcctctagtcccagctatgcaggaggctgaggcaggagaatggagtgaacccggcaggcggagcttgcagtgagccgagattgcgcccctgcattccagtctgggcaacagagtgaaactctatctcacaaaaaaaaaaaaaaaaaaaaaaaaaaaaagaaagaaagaaaggaaattggtaatacatttagcaacatgtagggatgagatattcttccatattctatttagaatacaataggcttcacaaaaatgtcatgctgagggcaaagtttgtaacttgtgaatcttgcagatttggatgcaatgtgttaaaaatagcaatatggaaaaggagatggcatcctactccagtgaaatggtcatactctttatggaagtgttgacattgctgtagaagtactgtgttagtttgttttcacaaggctataaagatactacccaagactgggtaatttataaacaaaggtttagtagactcacagttctgcatggccagggagacctcaggaaacttacagtcatggcagaagaggaaacaggcacatcttacatggtggcaggtgagacagagcaagcaagagcagggaaaactgttttataaaatcatcagatcccacgagaactcactcactatagtaagaacagcatgggagaaaccagccccataatccaatcacctcatacctggttcctcccttgacacatagggattatgggggttacaattcaaaatgagatttgtgtggggaaacagagccaaaccataccaagtgctaaagaagactactgataagttcttaccactatcctctccccgactatcctcactagggacactgaaataattaggacactatagcaagaaatggtttataagtaaaagttatgaatcaaagaaatttaaatattcatgttaacgttaccatatttatacacaagggcatggagacttggaagaattgtggctatattcaaatatgtaattttttatttctacataaaatttcgtttttggatgctctataatttgttagatcattttcttttcttgggaattttagttgttttcagttctttgcattttggtttgaaaactatctttaaatatgagtttttattaaaaatctattattatttcttaaaaattaaatcctgagtagaaaaaatgactcaaaggatgtatgaattgacaatcaccctcctaagagatttttaccaatttatatccaaatgttaggataaactatataaaatactaattgataattttaaactgtaaaaattgcaatttcataaaaaatatgtgtaaaaatgcctgtttcattgcatgcttaccaacctcttatcatttttcttacataaaaagtggtatttcatggccttttcattcatttatttacttttataattcatttattcatcaatccagagtgcatccttactatgttcaaaccagtatgacaggcatgagaatgcaaaggggactaagaacattcagcctgcctttatggtacttacaagtctcttagaccaaattatcaaccaaacagtcttaaacagaaacataaaatttatatttcataaataaatataaatatgaaaatgttatgattgtcatgtgctatgggaatctataaggaaacagctaatttatattgggagcatcatggaaagtgtctctgtaaaagtgacgtttgaactgttatctaaaagaggagtacatttagctaatgaggaattggaagaagagaatttgagggagaaggaaaactgtgtattcaaagattttatggcaaaaagataggatcatccatttatgaacttgaaagaggatctgagtggttgaaacagagattaggccaattgaattatctaatgaaattttactggattaagaatattattcttctcataagtgcaatggaaacgttgtaggattctaaataggggtgtggaaaatattttctcatgtatgttttgaaaacataattctgtgttgcaatatgaacacattagggtaggttaagcctggatgcggggagaccaattaggcaattttagtagaccagaaaagacatgagggtggcttggagtagggaagtgggagtaaaggcagaaaaaatgtaatagatttgtgagttatttgaacaactggatgaatgcttgcactttttattgaaacactgaaagagggaaatatctggaggtaagatgatgggttttgtggaatttaaagggcctttcagacatccaagtagaaatgtcaaggaggtaactgagtatacatgaccacacatcaaagaagtgttaccaatggaattttatatttgtgaattatttgcttctttgagttttaagccaaatacatgaattatctattaaaaaattgaactaaattttatagaataaaacaagtctgtatatcctgatgctaaagtatatctaagatctataatttgtcaaataaatgtttaataacagcatgttaattcatatgacataattttatactgttttaataaaggaaatatatctgtgtatatatacacacacatatatacacagatatatatagatatgtatgtatataatgtactatacatgagtgcatagggagagaaagaaagtacatataataaaaaactggggggagcattgcaatgtggatgtgacggtcataggttggtgatatttagagggtaggataacaatgggtaaaagttaaatttaactttctaatacttatatatttttgttttttcactgtgaatgtgtggctcttacaatgaataagaaaaaatatgtttaagtataagactgggaaggacgatgaatcaggatcagcaactggggactgggataaaatcgattccaagagcttttgccatatattacaactttgagttatctgcttcccaagctatatccaaagttcaaatgagacaaaaagatacttcagtagaaaatatgctttatcctttcttgcagttttatctttgtatcaaaccagaccatctggaatctttgctcagatacatgtttagtacctgaaaatgtcgttcactgagttccactctggtaccatggctttggcccactcggtggaatgctaaataaaaatacacaggaaacctgcttttgcatttatgacagtgtatttgaggatattttcttctttttactcatacaaataattccttgaaactcaagtatcagaaattctttagcacttaaggaatgtgtatgtactgtctttacagagagtgtaaacaatattactaattttacatacttttttgtataattatcaagagactcagagacatatttgaagtttaacttttataagaaattaagactgtttgaccccaatgtctactttacaaatttactttggcatgacttcatatatataacaacctggtcttgttttatattgacgtatttttttctccaatcttaattttttattcatttatatttgtctgttcattgtatagattcttatgtgtctataattcagaagaaaatcaataagacacagttccaagatggccaaataggaacagctccagtctacagctcccagtgtgagcgacgcagaagatgggtgatttctgcatttccaactgagttaccgggttcatctcactggggtttgtcagacagtgggtacaggacagtgggtgcagcccaccgagcgagagccgaggcagggtgaggcatcgcctcacctgggaagcacaaggggtcagggaagtccctttcctagtcaagggaagctgtgacagacggcacatggaaaattgggtcactcccaccctaatactgcacttttccaatagtcttagcaaacggcacaccaggagattatatcctgcgcctggctcagagggtcccacacccaaggagccttactcattgctagcacagcagtctgagatcgagctgcaaggaggcagtgaggctgctggaggggcacccgccattgctaaggcttgagtaggtaaacaaagcggccaggaagcttgaactgggtggagcccactgcagctcaaggaggcctgcctgcctctgtagactccacctctgggggcagggcatagctgaacaaaaggcagcagaatcctctgcagacgtaaatgtccctgtctgacagctttgaagagagtagtggttctcccagcagggagtttgagatctgagcacggacagactgcctccttaagtgggtccttgacccctgagtagcctaaatgggaggtacccctccagtaggggcagactgacacctcaaacagccaggtaccactctgagatgaagcttccagaggaacgatcattccagcagcaacatttgctgttcaacaatatttgctgttctgcagcctccactgctgataccctggcaaacagggtctggagtggacctccagcaaacaccaacagacctgcagctgagggtcctgactgttagaaggaaaactaacaaatagaaaggacatccgcaccaaaaccccatctgtatgtcaccatcatcaaagagcaaaggtagataaaaccacaaagatggggaaaaaacagagcagaaaagctgaaaattccaaaaatcggagcacctctccccctccaaaggaaagcagctcctcgctagcaatggaacaaagctggatggagaatgactttgacaagttgagagaagaagccttcagatgatcaaacttctctgagctaaaggaggaagtttgaacccatcgcaaagaagctgaaaaccttgagaaaagattagacaaatggctaactagaataaccagtgtagagaagtccttaaatgacctgatagaggtgaaagccatggcacgagaactatgtgacaaatgcacaagcttcagtagccgatttgattaactggaagaaagggtatcagtgattgaagatcaaattaatgaaatgaagcaagaagagaagtttagagaaaaaagaataaaaagaaatgaacaaagcctccaagaaatatgggactatgtgaaaagaccaaatctacctctgattggtgtacctgcaagtgacggggagaatggaaccaagttggaaaacactctgcaggatattatccaggagaatttccccaacctaccaacgcaggccaacattcaaattcaggaaatacagagaatgccacaaagatactcctcgagaagagcaactccaagacgcataatcgtcagattcaccaaagttgaaatgaaggaaaaaatgttaagggcagccagagagaaaggtcgggttacccacaaaggaaagcccatcagactaacagcggatctcttggcagaaactctacaggccagaagagagtgggggccaatattcaacattcttaaagaaaagaattttcaacctagaatttcatatccagccaaactaagcttcataagtgaaggagaaataaaatcctttacagacaagcaaatgctgagagattttgtcaccactaggcctgccctaaaagagctcctgaaggaagcactaaaaatagaaaggagcaactggtagcagccattgcaaaaacatgccaaattgtaaagaccatcaatgccaggaagaaactgcatcaactaacgagcaaaataaccagctaacatcataatgacaggatcaaattcgcacataacaatattaaccttaaatgtaaataggctaaatgctccaattaaaagacacagactggcaaactggataaagagtcaagaaccatcagtgtgctgaattcaggagacccatgtcacatgcagagacacacataggctcaaaataaagggatggaggaagatctaccaagcaaatggaaaacaaaaaaaaatgcaggggttgcaatcctagtctctgataaaacagactttaaaccaacaaagatcaaaagtgacaaagaaggccattacataatggtaaagggatcaattcaacaagaagagctaactatcctaaatgtatatgcacccaacacaggagcacccagattcataaagcaagtccttagagacctacagagactttgactcccacacaataataatgcaagactttaacactcccctgtcaacattagacagatcaacaagacagaaagttaacaagggtatccaggaattgaactcagctctgcaccaagtggacctaatagacatctacagaactctccaccgcaaatcaacagaatatacattcttctcagcaccacgttgcacttattccaaaattgaccacaccgttggaagtaaagcactcctcagcaaatataaaagaacagaaattatagcaaactgtctctcagaccacagtgtaatcaaaatagaactcaggattaagaaactcactcaaaactgctcaagtgcatggaaactgaacaacgtgctcctgaatgactactgggtaaataactaaatgaagtcagaaataaagatgagaacaaagacacaacataccagaatctctgagacacatataaagctgtgtgtagagggaaatttataccactaaatgcccacaagagaaagcaggaaagattcaaaattgacaccctaacatcacaattaaaagaactagagaaggaagagcaaacacatttaaaagctagcagaaggcaagaaaaaactaagatcagagcagaactgaaggagatagagacacaaaaaacccttcaaaaaatcaatgaatccaggagctggttttttgaaaagatcaacaaaattgatagactgctagcaagactaataaagaagaaaagagagtggaatcaaatagacgcaataaaaaatgataaaggggatatcaccactgatcccacggaaatacgaactaccatcagagaacactataaacacttctacgcaaataaactagaaaatctagaagaaatggataaattcctggacacatacaccctcccaagactaaaccaggaagaagctgaatccctgaatataccaataacaggctctgaaattgaggcaataattaattgcctaccaaacaaaaaaagtccagggccagatggattcacagccaaattctaccagaggtacaaggaggagctggtaccattccttatgaaactattccaaccagtagaaaaagagggaatgctctctaactcattttatgaggccagcatcatcctgacaccaaaccctggcagagacacaacaaaaaaagagaattttagaccaatatccctgatgaacattgatgcaaaaatcctcaataaaatactggcaaacagaacccagcagcacatcaaaaagcttatccaccatgatcaagtgggcttcatccctgggatgcaaggctggttcaacatacgcaaatcaataaacataatccagcatataaacagaaccaatgacaaaaagcacatgggttatctcaatagatgaagaaaaggtctttgacgaaattcaacaacacttcatgctaagaactctcaataaattaggtattaatgggatgtatctcaaaataataagaggtatttatgacaaacccacagcacatatcataatgaatgggcaaaaactggaagcattccctttgaaaactggcacaagacagggatgccctctctcaacactcctattcaacataatgttggaagttctggccagggcaatcaggcaggagaaagaaataaagggtattcaattaggaaaagaggaagtcaaattgtccctgtttgcagatgacatgattgtatatctagaaaaccccatcgtctcagcccaaaatctcctcaagctgataagcaacttcagcaaagtttcaggatacaaaatcgatgtgcaaaaatcacaagcatacttatacaccaataacagacaaacagagagccaaatcatgagtgaactcccattcacaattgcttcaaagagaataaaatacctaggaatccaacttacaagggatgtgaaggacctcttcaagaagaactacaaaccactgctcaatgacataaaagaggacacaaagaaatggaagaacattccatgctcatgggtaggaagaatcaatattgtgaaaatggccatactgcccaaggtaatttatagattcaatgccatccccatcaagctaccaatgactttcttcacagaattggaaaaaaactactgtcaagttcatatggaaccaaaaaagagcccgcgttgccaagtcaatccttagccaaaagaacaaagctggaggcatcacgctacctgacttcaaactatactacaaggctacagtaaccaaaacagagatacataccaatggaacagaacagagccctcagaaataatatcacacatctacaaccatctgatctttgacaaacctgacaaaaacaagaaatggggaaaggattccctatttaataaatggttctgggaaaattggctagccatatgtagaaagctgaaactggatcccttccttacaccttatacaaaaattaattcaagatggattaaagacttaaatgttagacctaaaaccacaaaagccctagaagaaaacctaggcaataccattcaggtcataggcatgggcaaggactttatgactaaaacaccaaaggcaatggcaacaaaaggcaaaattgacaaatgggatccaattaaactaaagagcttctgcacagcaaaagaaactaccatcagagtgaacaggcaacccacagaatgggagaaaatttttgcaatctactcatctgacaaagggctaatatccagaatctacaaagaactcaaacaaatttacaagaaaaaaacaaacagccccatcaaaaagttggcaaagtatatgaacagacacttctcaaaagaagacatttatgcagccaaaagacacatgaaaaaatgctcatcatcactggccatcagagaaatgcaaatcaaaaccacaatgacataccatctcacaccagttagaatggtgatcattaaaaagtcaggaaacaaccagtgctggagagaatgtagagaaataggaacacttttacattgttggtggaactgtaaactagttcaaccattgtggaagacagtgtggcgattcctcaaggatctataactagaaataccatttgacccagccatcccattactgggtatatacccaaaggattataaatcatgctgctataaacacacatgcacatgtatgtttaccgcggcactactcacaatagcaaagacttggaaccaacccaaatgtccatcaatgatagactggattaagaaaatgtggcacatatacactatggaatactatgcagccataaaatatgatgagttgtcctttgtagggacatggatgaagctggaaaccatcattctcagcgaactattgcaatgacaaaaaaccaaacagcgcatgttctcactcataggtgggaattgaacaatgagaacacatggacacaggaaggggaacatcacacactggggcctgtcatggggtggggggaggggggagggatagcattaggaaatatacctaatgtaaatgacgagttaatgggtgcagcacagcaacatggcacatgtatacatacgtgacaaacctgcacattgtgcacatgtaccctggaacttaaagtataataataataataataaggaaaaaaaagacagaaaatcaattagacagaaaaaaataggagctcttcaatcacagtggaaaataaagtcatggttctggatgagattggttggggacaggaaataaagaagaagaaaacaggcccagaacttagtataaagcaacttttgcatttaatcattatgtataggcagagattcagaaatacagccaaagaagagaggctaaggaggaaggatatcagaaaagttggaagccgagaggtgagacttctaggcagtagccacctgtgaggaatattgctcatgggtcaaagaagtcaaggactgaaatgtccactggatttctcagtgtggctctttggacagtgttgggaaaataatgagatttgagtggctttaagagcaaatagcacataaggaaatgaaaatatgggatataagcaaatgatactttcatgcttgttagacatttttcttttttttggattttgtttatgtcttttgttctttttacactggggatatactttttctttaataaataagaatatgttatatattaaggatttttatgcctgttaaatatgccataaattcttgtttgacatacacttttctgttgtggttaatataaccttgatatcagccggagttcagctagttataaaagagcaacctctgattacatatgattctgtgataatcttattacccattcaattaatatatatttattgctttcactatacgctcacaattttataagaattggcactataattttaactgaactttgacaactcactagagcagtaattttagtggatgcaaatgggatattttaaaattattgaatgagaattacaaattttagaaagagccaaacagttatgataagtttcctgaaagttaattttaccatagttttagttactattttgtaaataattcaaaaatatgtaacagttgatcttaggctaaaaagttcatcatttgcggtaactagtgatagtgagtcaagtataactataacactaataaagagtattaactgcatggaaagtgacttttcctagagtgcagagaaaggatattgcacttggtactcaaattaaagaccgaaaaaggattttttaaaaatttagcagagttcatatctataatgttggtaatgatgcaaaatttaccacaatacatttagataatctgttactagattaagacctcagtatttctcatgactctatatttttattcgttcagaataattttcaaaagctcttcctagaggatctttgagtactttgcataaattaggtttatgtaaaagtgaaatagaagattaccaaataaattaaaaacaacaaagggtagcatagaagaccaatttttatctacttggccattactattcttacacagttttgttgaacgctccttttaataattattcatgtaaggtatgccactggatttacagaacaacttttttgctatctttcttaaagcttttgaacaattagataaaacagtaattactctttgatatggtttggatctgtgtctccacccaaatctcatgtcgaattgtaatccccaatgttggaagtggggcctggagagaggtgattggatcatggggtggatctttcatgaatggtgaagcaccatgctcttggtgctgtctcctgatagagttcttgtgagatctggttgttcagatgtgtgtagcacattccctctctcactcttggtcctgttcctgcctgccatttaagactactgctcctgctttgtcttctgtcatgattgtaagtttcctgagacctctccagaagcagaagccattatgcttcctgtatagcctggggaaccatgggccagttaaacctcttttctttatcaattacccagtctcaggtatatctttatagcaatgtgagaacagactaacacactcccttaaggtttacaagaaacagtgtatgtggtttaaaaaaatatttaattaaatactcagatcaatactggatcatatgccctgaaattttcatttactatatgttataataaaacttcctataatttctaacctaatctcaaagcatgtgcttagaaaatgaaagaaaatatgtaactattttctaatatgaccatacatcaagtactatatgccgtaaatgaatggaaatcaaaatatttgtattgtaataactgttctattaataattttctaccttctactttctcaagtaaaacatagaatatatatatatgtaagatatgttatatatacatgtaagataaacagtttaaactagtactaaattctaatttgattaaaggtaatgactttgtctaatcaaaccctgcagtcatcacaacttgttaggtgtcataatagtgtagaggtgaagagaatcactggccctggagctaactgcagtgatttgaatcttgactgtactgcataatcttggaaaagcttatcatctttgaggcaagtgttacatttatatgttatttttcaaaatggcaaattggggaaggatggtggagagaaaagcaactcttcactgacaaataattttatcttgtgtgtgtgtgtgtgtgtgtgtgtgtgtgtgtgtgtgtgttggaggtataggggtgaggagacaggtactggtagtggtaaagtagacttctaggcaagaaggaaatgtgtagaactagaagatggatttctggcaaattagaaaacagtttcgcaggactttgtagcaaatcagaagttaatgtgcttcagaataagaccagaactggtgatctcacagtcaaatctagtaaacttactaatattatttaaatcgtgaaaatagaaagtaagtaatttttccagtacaaaatgagtgctgaacacttcaaggaaaactcaatgccttttattataacaattgtgtgaccattagcttaaggttctccatttgtaagatacaggcgttcattgagggaatatctgtcatttctcagagtcataagaggctgcaaccattttgctacagctgaacaaaagccatatgtgcccaagtcaaagttgcaattattttcaagatcacgggtcttttgattttaggcacaggaacaaagcgaattgaatatattttccatttaggctaggttgatataattcagtttatattcagtggggatagaaaacactcaaaattaaataattgaagttttcacacttcaattgtagtctaaattgggaaatatatactgtttactatattcttagctaaatgagtcagtaagtccatgcagaaggcaccatgattcagtgtcaacctcagaaaggttttctttaacttataaaatatatcctataaaatgatggaaaataccacatcattcaggtgtcaacctcagaagcgttttctttaacctataaaatgactgaaaacagcacagggtcagtttttacagttcatgtttgataagacaccaatgcagaaagattggtaaactattggactggtaatctattgagagttttaataattgttgtattttgtatactttttgattctaaaaactattttaaacaagatttctgtatttctgtttttttttaatcaactgtctgctcaaataagaacattcttttaaataataattttaaaagagattttcagtactcgaactgagtatgcttcagattttatagcatattgtatactctaaatttgttaatagttttaatgattaatgctttacacaaagaaatagtaaagattaatagtaaagtattcattaattcaaaccaatgactgtaataagatagcactaaatgattatttaaaataactccaagacaatcccataaatgttggcaggaagaaattggaaagagaaaaatacaacctttttttccccttcaaattgaaatacagatttcacatgcactaaaattttcttcaaagttcatattgcatgattaatctttcaagaagactgtaagaattttataacattatatgctaatacctctccccctaatcaaaacatcaaaaaacatatactataagaaataaaaagaaaaacaaacaaagcaaaacaagcaaggaagctgctcaaacaaaaggaacacttaacttctatcttggtgtagtaagattagaggcaatttcacttatttcccaactggagtctgatttttttttcattctttgcactcctatacatagtagtaatgaaggggtgcatatgtgtggataatcagagataaaggagaaagggaagattgacgattttagaggctttttaaaaagtgtgattttgtgtttatttattctagttagtggctactaacctctgctcctttaatttaatcctttgagcctggcacatgaaaatattttctagagatatatgttactaatacctcagtgctcagtatttcaaaatagtaaacacagaggatgaacttacagaaataacctgttttttcttatttttttattataatggcaactgaaatgtcataagaattaatatttatctccattttattttgatatgtttgttaatgtttaaaaataatctttgcatgaataagaacattgagacttcaagttaaagtgaaatcaccctcatgtatcccccatgcaactgcctttcacaaagctgagactgaaatcaactgctattgattttcaccacaaagttgaattaaagtgaagccagccttcaataacaggtagggattcaccattgtatttccacaaatacctatacttcataatgttcaatatgagaaggcaaaggcacatagagtttttaaaaatttggttacacacttgcagacacagggtttactcagttcatagcctctgcagattactggaaattaaatctaatctgagatgtggtggaaactgctagtttacagtagttttttggagagtgtgtgtggtctttgctagttcttggtgactgggagaccaaaccagtgttggccttggggcaagactagggaatagggaaggatgaggatgaggaacagacagaagagggaagggtggaggggcgactcatttaccatttctctgccagaatagtgactgacagagagaaggaaggccaaaaagtgcactttacagatgacataaattttgttcaaaagtcatttgagaaagtttgctggtacttaaacgtttctagctaagtttgccctacttggaagggcattttcacctgtccctcattcaccttcttcagtccctctagatatccttaataaggctcaatgatttagagcttgagtgttggaggccacggaagcagaaacttgttcagccactcgagggctacaaatgggttagtgtcctcctttcagcaaaaattcttagtctctttacttttatagaccccgttacgttactatttcctttgtaatcttatcccaccgcccagttcttttctttcccttctccctctttcctctctgtctgtcctctcctcacctgtccaccgcaatggccgtcatggagtagatgctggcgaacacagctgtgataggaaagaagttctggaagcggcagtagttggcgccaaagtaccactcgctatgaagcgcgtagatgaaattgaccaacgtgttgaaggcggccatggaggcgtcggagaaagccaggttcacaaggaagtagttggtgacagtcctcatgcgcttgtgggccaggatgatccagatgacgatgagatttcccaaaactgccactgccaccaccacaccatacgccagggaccagagcgcgatgcgccaggacggctgcacgaactggttggtgaggttggcccagggctgggagggcgcgggggaagccacaggcagtcccagcgcggaaggggaggaggagaggttgccagcttggtccagcagttgcagccacccagtctcaactgcccccgtggccgccccggcagctagcgaggcggtcaggttcacggcgtctgcacccacgcctccacccccgtctatccaggtttctgctgctgggagagtggccatcgccaccggtctgcagtcccggaccctcccactcacccacgggcagcccaagacgagactcctctgaagttcttctctgcctcctggtcactttggtgccggagtcttcagataagactggaagctgaaagatactgcaat

SEQ ID NO: 486 - DNA, 83836 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtcctggggattgcgcgtttaaaggggaccctccctctccccggatcttctctgagcttggcaagttaatcggaagcactcgctggcctctcacctctcctatctgtttgtttgtctgtctctgcgtctttctctctgcgtgtcaacgtaagactcggtctctggatctctctctctttctgtctcccgcccccacaacctctgtatctctgacaggtccgcggtgaaactccgcgatccgctccggc

SEQ ID NO: 487 - DNA, 94214 bp, Homo sapiens
gaatgtttgtttaaatttatttgtttaattgacaataattgcacatatttatggggtacatagtgatgttatacatataatgtatgtatatgtgatgcatataatgtataggaatcagattaaggttattagcatatccatcatctcaaatagttgtcatttctttgtgttgggaacattcatatgttccttctagctacttgaaactaaataatatattattgttagctatagccatcctactgttatgtcaacaaaagggaaattcctttaatgtcccagccctgagccagtgcaagggcaactcacattagcagctgggatgtccaggaacaggaagtttcagagggccaggttcagacacagtgcccacttcaaagcctgggaaatcaaagatttcccaggcctggtggtctgggcatctctcttttctcttgcagaggtggcaaaactcgacctctgtcctcttagggtcctacctgggcccaagaattaaattgatgtaagacaggttaacgggagaaaagcatacaaatttatttaatacatgttttacaggacataagagcccatatgggaaaagagcccatatagggaaaagaagacccaaggatgcagtgagagtcaatcgcttctatactggttgcacaaaggacagtagttttgaaaaggcagctaaattatgtggggaggtttaaaatagaagaattacttgaacaaggtctatacagaattctctcagttccaatttctcatcattgatagggagaatggtattccttctgtgacagggaggccatctcccatgtgggaatttcatctcctgctgttaagacacagaattaagatcagagtgacctcttcatatctgatgtttttaaaatatctgtaattcaaatagtcaatatgccagagcagcacattttgatggcataattcttaacctcttcactctcttcctcttggagattgcatgtagcctcctaagagtacgaagtttaactctaccataagtaaagtataaaaatggcttcctttcctcactccaagagactccaggcccaaaagataactccagaaagtgaggaactagagcataggccagaacctgcttcttttccatctcccctgcaataatcaaacactctctaaggtacagtcaaagaaagaatgcaaaggatgaaagaatttacagacaggtctgtctgtttgggcttttctcataaaatgtggccatcaaaatgtcataacgggagtcacggccaggcttgacttctaatgatgagaaaagttagataatgcccttctttgtgcttttcacaaaagcagggagatctcttgggagaaaaaggatttatccttctttttcttctttagatatacaaagagacatctggggacagggagtggcccagggaggagttggacatcagaatttagattgcaaaaaggaacactggggagggctgacttggttagtttgctttaattactagcagtcaaagagcaactcacaatggtttgcaccattaggaaaagtgattattacacacaccaaaaaaaatcccaaggaagagggactccagggaagaggcttgtcaattcagtggctaaggatgtcctcatggaccatctttccactttctgctgtgcttcttcagcacatcaccttcatccccatgctatttcctctcaaggtagctgtattagtcggctagaactgcagtaataaagtgccacaactgggtagcttaaataacaaaaatgtattgtctcacagttgtggaggctggaagtccaagattcaggtgtgcacaggattggttccttcttagggctgcgagagagaattcattccatacctctctcccagattctgatgatttgctggcaattgttgacattgtagatgcatcaccacgatctctgccttcatctttacatggtgtagctagtattcaaatttctctttttaataagaataccagtcatactagatcaggaacccactctactccagtatgagctcatcttaacaaattacatttgcaatgactctatttccaaataaggtcacattctgaaatactggggattagaactcaaacatgtcgtttttcggggcgagcggggagggcggcggggaacacaattagaaacaaaacagtagcaaaatggctgctccaggtgtcacacctacaaacaaagtccctagaaagaagaggctgtatcttccttactccttttgagaaacttcacagcacacacagcatcacgtctcaatggtcataactatgtcatatgccaacctctaaccaatcactgttgaaggtgctggtattgcagagatgtggaggtgaaatactccagataatgaaattactaccttgcctgacagacaaagagaaggaacatagtaaagttttaagcatgtgagttaccatgtttccgtaatctttcagtcctctaagttgttagcttttctcctttttcctaatcacatctattagcttttttagaatacatgttcattgaagaaaattggaaagcattaaaaataatatattttgaataattcaaaaatcccaccaagacttcttctaatttcccttctaatttaccggtaagtacgtgtttattgaaaaaaattgagacaatattaacattttacaaagaaccaatttaaaatgattcataatcccatcgagatatcccctactaatgtactagaaaatattttcccatatgtatatgttatatatacatacatacatatataacaaaaagtgtggctatagtgtgcgtaccgctgagtagcctgcctttcttcagttagtattaatttgattgtttgcatttcctttctgcttgtggtaatgttattaatcacaactatctggaacaccttacccccaacacatatttacactctacagttctcttttggtatcattaattgcaaaagagttccagctcaagttaaaccacaggaaaaggctcttggttccagtcatgggaggagagaagaggtctgatcagaaatgaattcgacgttattcattaaacccaagtcaaacagtcaaatgtttcctcctttgtgaagtatttttcactgactcctcctccaacctaaggagaattctcccatttgtgcacaattactattgagctgactgtccatgttctctaacataacactctgatttgtgatatcattggttttccacatgccatgatacccttgagagcagagatgagctctgatctatctttatatctccaggcctagcatcagtagacattgaatatgtgttttattgaacaaatgaattcattcattcattcacagaagaacaagctcagaatttttttccttattctctaccatagttccctacaatggtttatcataatttcaaaaagaggcaaagtttgaacaattaatttttaagtattatttggaagaaagtgaaatataattatttcaacactaacctagatattatgcttacatatcagtgaggcatgtgccttaaaaagccagatgtctgtaaaaatcaaataataacttgacaaccaggtgatggttgctaggaaactgcatttttctgtgaaaacatgatgtatgaagtgtagcctagattcatatcctacattaaacatcttccttggagttatctatgaagtctgattttgcatggcttgtcaaggtatataagttattccctcagttatcctgctcctgctcttaaaaatcatatggttctatacatagaatattatttcaacaccattatttgttctgaactcaaggttgtttaggttatagattgaggccccttttggctccaaaacttttcagtggcatcaaatgttagttaccctctcatagttgtcactgaggaacaaccttcacttttgatgtattaattgtgctaagtgaaaaaaagtaaaatatgtacaatgtttctatgtattccaaagtgaaataaaaataaatagaaattatccatgagttttgaaagatttttgctcaccactactggaacataatagagattttactatactctgcctaggaagttgactcctgacattgatagtgaagttccagaaagtgctgaggaactttgctaaattcaagagctgggaattttgtttgaaataaatatctcaatatttaactgctgtattaattagaaaaattgtattgcaagaaacagaaacccaaatcaaattagttaaagccaaaaaggacatactgagatactagaataacttgggtaacttacaaaattgaaggaactaaagaaaaataactgaaaagtactaaggatgtcaggaactagaaccaaagacaacacaactctctccaatcagtccccatagcttctactgttttctcagcatccatctcattttcccgggtttctccttgtgccaggaacatgaccaccagaagctctggggtcaaatacaagaggcaagagttttggctctccacatccttagaagtttctgtgtaaagattacaattgacccagactgggtgacttgcccagcttgtggcaaatgggtgaggttaagtgcattggttgacaatctccagtaggggttgggagaaaccagtttctaaaaggaagagtgaagcttttacatggacaagggcagaagtcaaggtatgcagaaacaatcaacagaagtgcattactccaaacatatccagcaatgattttaataccactttcaccagttttgtcaccacaaagtgacaggacaacccagctcctaacttatacaatgtcatctttatgactattctaaaatgctttgaactttttcatcttaaaacaccaaaggatcgctatgacagcgcaggtgctttttctcacgtgcatccttctacgaaatgcttagacatgaattctgaggcttacttttcacaaattaaaagattttttcatggaaacacaaaagatacaaaaagtagaaagatccatatgaagcaccttcctccacagtttctaagcttctaaaatcaatgtttcccagttcattaacaagctcgtacataattattagagtaacaccattaaggttagcacatacaatgactcccaaagaaaaaacattgtctatttataagcattgctgtgaatgggtggaacgtctcagcaatacagtcacaagcagcagtcccggtgttctcactcagatattccacgtagcacttcatagtatgctttaagtgagggaatgtgacctatagatacatctacacgagaaggattcccataaggcataaactgttcaataaacaatcataaaaatatattcattcttccctatctagaaatctatgtctttatttaaaaatacgtgatgattcatgcttaaggacgtgttgttggacagttggttacagtcttttatctagtcaaaagattcttatctgccagaaatgtgataagtccacttataactagtctctcaaaacatcctagatatttttctctgtatgcatagttaatcatacaaattaatctaacctaatgccatcttgttaccctaaaatgtttaatgataatggcttatcatctttcatccccataaattttctccttgctttcagtgagcagcaacttcactcccatatacgcacttgttgtgtattccttctcctgccaaattcacacagtcacctcctcttccaggataagacgtttactgctgataatcacagccacaggggaaacaaagaactgccatgctcaaatgagggtaaggtgaggcaggtccattaatttacaaagggactgattacaaacatgcaagtggggtgcagggaaaccacaggtgatgctacatgaacgcagggctgaagacagtagagctgttactacccctaggccaaagggacagagagatagtgggcaccaaaaccaaaggaggggaatctacaggcaggtgctggcccagcaacagttttttagatgaactaggtacggaaattgagaataagcatttataaacttcaacagtaatcccaaagaataattgtgtctaataaaaaatgaggtttatctaataataaaaatggggttggattttctatgtctttttttttttttccaagatggagtcttgctctgttacccatgctagagtgcagtggcattatctcggctcactgcaacctctgcctcccgggttcaattctcctgcctcagcctcctgaataactgggattacaggtgtccgccaccacccccagctaatttatttatttatttttaattgtatttcatttttctagtaatttctttgaattctatctatttacagaagtgccagctattgataaattggaaataaggaaaacaagctgggccttagccacagatattgtaagaagcttttctgtagagaaggccttcttgggcaaaacaggcagcccaaggatacccagtaggaggatagtcaaggaaattgatactctatccttcctctcttcacttcctccagtctcttgtcgaagttctccatttggctatacccactgaggtccatgtgggtcagtctctggaggcaaaaagcaggatacagaagggtggagagtggatccccatcctgtacagttgaaaagtctatgtccccaacattgcaaatgcacgaagtcccatcaccacagagtgatgtcatttagtcacggagtaatgtctccctgtgccacttaccaacttactaacactgaactccaaattcactctaaatacatgctctgtcataatgaacagaattcctttagcacccatcctttacagtgagcatgatattgagctgtctcagtagagggcgctggagggatactgcaacaggaaagggctctcctgctgtttgcagctgctgcaagaggtcagcagtgtgggtgggagggcttttgtcatgctcttccctggctgcatccctgagcatggggttcctttgcaacttctcagctgcagcctggcctagcattaaaaatagaacccattacacaggtttgttgtaagtaagtgttttttgttttttgtttttttttttgagacggagtcttgctttgtcacccaggctggagtgcagtggcgcgatctcggctcactgcaagctccgcctccctgattaacaccattctcctgcctcagcctcccgagtagctgggactacaggtgtgtgtaagtactaatttttaaagggcagatataatcagtatattaacatgcagttctcacaggggtaactaaaaacaacttttaattttattcctcactgtctgcttgggagtgaaggactggctagcccttctcctacccctggatgaaacttggggtggcacaatggctgttctcacacaggactttggagggaatataaaatcctacaattacttcaagacacaaacatagtctcaagtcagttattgaaaatgtccaatccaatgcatcaatcagtaattcaatttgtattcaaaggtaagacttctgggaaggaatccttctcttttatttccttactccccactgttcactaattggcttttggcccttccagggttaagtgctcagatgaaggaaagaaaaggggataaaaaagttcatacttgacagatactgtcaaaatgttgcttaatgctgtctgtctgacagatgcttaagactaacctttcttttatagacacttttgggattcttcagaggggttcctgccaagtgatgtattctagttctccaattgccccacatgacttagtccttggttttccagaagttcactcagtactgaccttcttctattttcaagatagtacccctcttacacaagattttaaattgttccaaaccagaacttacacaccactcggctcacactagaccatgggaatattcgtctaccttttatcccaacaaactctacgactgaaggtcaagctggggtagcaacaactctcctcacttcacctgcaaaagcacttgccagacctcctctgagcctctctacagacaccacccgcagtgtctgtgaggtctgctaatggagcttgccacaaaatacagactgaaacaagttttataaacttcctcagctttttgagagagggaagaatttcccatttgaattcttccaaggagatttccccctgtactcataacttttcatctttatttttctttcctatgacccctaagcaaacatcctgttggtgaccataagcttggcaataaattatccacgtgttgcctcactggggttttactaccagttggtctatactgttgtgggaataacatgcacagtcactgcagaaggaattaagccattgtataaactttaaaacatgcaagcccacccattaaaattgttccttgttattcttaccgtatatatccaaagtaaatgaagttgagatttgatgtcatcagtagcccatttgattatctacaagaatcagataacaaactggtattatgggggagagatataaataggaaatcagtgatgtgctcaaactgtaaatctagccccgccatggcttatttctataccagttgcttagcatggccaacccgaaagtcaacgattttaatagtccctgaatagtattatgatgatctctggttacttagtagggccctacctagcagactgtttctgctttaccacatttggatgtcagatccaacttttcttgcactgactggctgtaataacccatatggggcagggggagaaataagtggttttttaaatttacttttgccagtatgtgttaatagtacttagtttcataattctggatgtggctccagtaatcagaagagctttaaacagaaagatcaaagtccatagaaaagagttttgtttccgtttccttagaatatagatcatcctgtgaaaaacataggatttcttcaaggtaaataaatagtactcacaggaggctaaggcagagaaactataatgacaagtagttcaagtgtgtaaagaaaaatactggttattaggaaagactgctcagatgggccagtataattaaaatagttaaagtgacaagggattgatctgaaacaagtcatgagaatccctacaaaaagcagttccctaaactggctgcataagaaccatctggagtaataagcttacgaattaaactgatacaagcctgtctgtacctgagacagccgatatccagtctgggcttcttttcagtaagagaattctgattttattgctggtaatgtatccagctaaaagcaatgtttctcagcttctcctgaagattggtatggccatgtgactaattctggtcattgaatacaagtggagattattggctattacttctgaaaaggctctttaaagagggaggaagagctgagtttgaactttttgcctttctacccattcctccttctatgtagaatttagaccttaaggctgaatctgtagcaaccatcttagagcatgaagcaatcttgaaggtgggagtcacaagttaaagatggcagagctaatggattaaaggagtctgggttcccagccaccatgggactgccatgccaaccctgcactgctccttccacacttgttttataagaaggaaagtaaacctaacatagataatcctgttactatacaccatcaaatcctaaacacagtgctactggcattttcttagccttaccagattgcaacagatgattttcattttcaggcaagtataactacctccacaatgctacccagctgtcagtgattacagcataccatttggggaaatgcatgtcttagaattaatgaaacaggtatttagagtcttcagtttatccagctgccttagcttgcctgaaatcttactagtaaactcactgattctgggaccatccagaagctggaaattcccaatgtggaagagaaatggccatgagagaatgccttgtgcatacctggcacagaaaggaagctaaggaaaagcaatccaacacagacattgccacccacagttgtatggaaggcaaagtatcagtgagaaagaagctgtagtaacatcagtgttggagaatctttatttattatagggttaacctcttgtaccgtaatggaccttaaatgagcacagaagtctggtctccaaagtgagacctaaaggaagatgatgccaaccagagcatggaggacagactggaagttttcccctggcacaggccatcagtaatcagctgttgatatgcctatgttaattgtctggtaaactcgtggtgctgttttggctcttctcaactagttcactttttaaaaatttaagcacctcattaaagaaacccttttagatgtggtaaagcgaaacagtctactaggtagggccctactaagtaacgagagatcatcataatactattcagagactattaaaatcgtcgactcttgggttggccatgctaagcaactggtatagaaataagccatggcggggttagatttacagtttgagcacatcactgatttcctatttatatctctcccccataataccagatacatggtagtcactcaacaggacaaatattaaataacaaatgacacaatacatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtc

SEQ ID NO: 488 - DNA, 62650 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgct

SEQ ID NO: 489 - DNA, 115991 bp, Homo sapiens
agtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccgaaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctacctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttgcattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcgtatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactctcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacatgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagagatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccacagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattcctttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaaaaatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgtagtcattccctatctcattgcctaattttatgttcttcattatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaagcatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaataaaaaaaaaataaaagagaccataatgatttttcagtctgaaagatggagattagggataaataatctttaaattatgaaaggtatggccaagataaatgcagtcacctttactggtaaactaaaacctgaaaagtgagaatgaggtacttttaaggcacatgcacagaaataggtagcaaacactaggagattatccatatttgtgaattgaactattatctaaagtcatcaactgttatgtaaagtcattgattattaaagtcactggttattattatacaaagctattttggagtgttttcaaaagaatgacagcctaacataatgaaaacatcactgcactttgagactgatcttgactccattgtgacctcagataagtcacctaacccctcctagcttcagtttcctctcctgcaaaaggagaacttgtagtaagtggctgctttggttccttctaaaataggttgatgtttcatagtacatcccatggtgccattgtcaaaagcagaccgcaaggataaatgatcccttgaatatggagtgtgaaagtctccatattcaattctgtggagattcaaacagcaggttcttttataaagcttatgtggaatgttctgtatcagtttcttgtcattggaatcttactagctgtgttataattaatattttgcccttaaaattcccattttacagtgaaatacagccaataaatatctctctgctttaaaaggtaaaatgaatacatagaaaatactaactagtctctttgctggaatccatgtcaatagataacatttatttctgaagataaataagttgcctgcttccctcttgtgtttcatatgtctgcagtgaacagtaatgagtatagctgtaaattagttatgatataaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattagaaataatcgaagttctttctgaacataagcatgacaaaactgacattgaagaatcagaaatagaataattgttaagggttcagcactaatcaaaaaaaagaatacctcattgactgtatttaatttgaaaaaacgaaataaaacctccttaactgctccagcccaaaaaaagagaagaaaggtatatgatagaaaaagaagagaaagaaaaggaaacagaaaggagaaacaagaacacagtaacaccacataggcagtaacggaactcaaaagggcattggggctggtgagaagcacagatagcgagaaacagaaagatgaaaacaaaacaaaaagaaaagcaatcagaagtctcagagggcatcactgtattgtagtcaaatagtggtcttagacttttagccccagtatctcatcagtcaccagaggttacagatcccttggttactgtttttctggcatccaccccatttttattatcctggtgaccactaaggaatgggcctccatcacttatgtccgcattgtctctgcctctcactttaactctttagtatgtcccacacacacgtaaaagatgaacttcctaaaataccatcccctacacattatttccctgttcaaaaacattcagcagctttcttgcctgtaagttcattctccgggtgctccgcagtgttgtcccaaacagttccatttctcaggaattccttatacagtcatagcttgtttctttatattttgcaaatactgtgatttttacaaattgaaggtttgtggcaatagtgtcaagaaagtctattggtgccatttttcccacagcatgtactcactttatgtctctgtgtcacattttggtaattctctcaatactcgaaacttttccatgattattatatccattatggtgatctgtgaacagtgatctttgatgttttgggggtaccacaagaagtgtccatgtaagatgacaaacttaatcgataaatgttctgtgtgttctgactgctctactgactggcaattcctccatctctctccctctcctcaggcttccctattccctatcacacaaccatatggaaattaggccaattaataaccttacagtggcctccaagtgttcaagtgaaaggaaaagtcacacctctcacttgaaatcaaaagccaaaaatgattaagcttagtgaggaaggcatgtcaaaagctgagataagcccaaagctaggcctcttgtgccagttagccaaggttttagtggtctgagtagaagattaaaccagccacaacattcccttttaccaaagcctaatccagagaaaggccttaactctcttcaattctatgatggcttagagaggtgaggaggctgcagaaaaaaagttggaagctagcagaggttggttcatgaggtttaaaaaagaagccatctcgataacgtaaaagtgcaaggtgaagcaacaaatgctaacagagaagctgcagcaagttatccaggagatctagttcagaaaattgatgaaggtggccacaccaaacagattttcagtgtacaagaaacaaccttccattggaagaagatgccatctaggactttcataactagagagaagatgtagaaatgcctggcttcaaagcttttaaaaacaggctgactctcaggaggttgaggtgggaggatcacttgaacacagaaggtcgaggctgcagtgagctataattgcaccactgcactccagcctgggcaacagagtgagaccctggctcaaaaaaaaaaaaaaaaaaggcagactttctcattaggagttaatgcagctggtgactttaaattgaagccagtgctcatttatcattctgaaaatcctagagctcttaagaattatgccaaatcttctctgcctttgctctgtaaatggaacaagaaaacctggatgacagcacatctgtctacagcatggtttactgaatatttttaaacccactgttgagacctactgctctgagaaaaaagaaaaaaaaaggattcctttcaaaatggtagtgctcattgacaatacacctagtcacccaagagctctgaaggagatcttttcatggctactaacagccattctgcagcccatggatcaaaaagtaattttgactttcagtcttattgtttaagaaatacattctgtaaggctgtagctgccgtagatagtgattactctgatgaatctgggcaaagtaaattgaaaaccctgtggaaaggatttaccattaaccacatttgtgattcatggaaggaggtcaaaatatctacattaataagaatttggaagaaattgattccagccctcgtgggtgacattgaggggttcaaggcttcagtgaaggaagtaacagcagatgtggtggaaatagcaagagaatgagagtgagaagtagagcctgaagatgagactgaactgctgctcatgatttaactttcatggttgaggaattgcttcttatggatgagcaaagaaagtagtttcttgagatagaatctactcctggagaagatgctgtgaacattcttgaaatgacaataatttagaatattccataaacttagtaaagcagcagcagtgtttgagagaattgaccctagtgtggaaagaagttaaaactgtggataaaatgttatcaaaacagcattgtatactatagagaaatcttttgtgaaaggaagagtgaattgacaaatttcatttttgtcttatttttaaaaattgccacaaccacccagccttcagtagccaccacccttatcagtcagcagccatcaacattgaggcaagaccttccaccagtacaaagattacaacctgctgtaggcttaggtgatcattagcctgttttagcaataaagtgtttttaattaagatatgtacattgctttttaagacattctgttgcacacttaatagcctatagtatagtgtaaacataatttttttgtgtactgggaaaccaaaaacatcatgtgacttggtttgttgcagtaatgtggaattgaacctttcaatatctcagaggcatgcctgtactaaactttcacttcagccaaacttatctactcctgttctcaaaagcaccctgtgtacatcttctttttcctcttcttatataaaactgattctgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggggttattttaatgtcttctacataggcaagtctgagtttggttggtgaccctcactattagcctctccccttcacataggagtgaaggctttctccattacaacccctccccaaatctggggtgctgtcagagttgccaacatgtaaactttaccaaagtggaattctgatagtcccatgacccccaccatgtgtcttagtcccaacagaaaaaccatgtgtgggcacaatactgtcctgtcacaccaaaggctgtgctcacctgagagacagacactaagttgtgctgagtctttgtaaaatatcttcatgatgtttcatttgttttacttgccgtttcagggtatagcttcccacactatggatttcctacttatggtgggattactttccatcctggaactactaaatctaatgctgggatgaagcatggtaagtaatgctttgttcttaataccaagaaaggaaaaaaataattaatgctaaaaagggtttttaaaatcattacttatcacaacagtattatcatcttgacaaataattgatgaatgcaaataaactaagaagatacttttcccaaaagatattatttcctgtggctagtataaactctattacttttatatattttatatatttactttgtaagtggcatgaacagaggaaagaaaagagcattgaaaagagacaacagagacctgactattcaaatattttaaacatcatcaaacttaatgtattctgtctctttttttctcaaatagtacacttctgaaatcattttgagttttataggatcggtcttttcccatcaagtcatcccctgagaagctgcagttaaaccacatgttgatagtttatattacaggtccattctagtgtacccatggaagaaataatactataaagaagtcttcccatttattgaatacctatttttgtgccaagtgcttttacatgttttaactgttatcttcatgactgctctatatggaaaatagtaactccattttgcacacaaaaggcatcaaagttcagaaatgttcgtactcactgaaggcacacagaagttagtggcagaacaagaatttgaagcaggtctcctgcagaaaagctagatgctctcatagtatctgtcagataacatagttgaacctgaaagagggtgatcaggaatggtacactggataactcccacactaaagaatgtgagtcgacaacacgtctttatgatttgctttgttcattagcattaggaaaaaactgctctgttttcaagaactttaaaaattcagctttcctgcaattcatagaagagctttatttcatttttctcctttacaaataagcaaaatgagatttaagattttagaagtatactaaaaatgatttttagaaatgagtttagaatatctccaaaacatggtatttatgatatgaccatttttaaaagaattttaaattattatttttcttttccttttgcagcaaacttgtctcttacctttatctgacctacattggaatagcgaattatcactaaatacattttactgagaaaaatctgatgtttttgcatttatcttaggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcagggtaagtgagcacacaaattacgttctgttggttggctggggaggggtcagtcctaggtgcagaaagatatctgctaatctaaagatgatatatcaatatctagtttagtgtactcttcaaagttctgtatgcctttggaaaagcatatgtcagatcattttattcacactgggatttccatttttgctctgttatctttgaatgtaaaggacagaaatttatatgtacattctccagtcataatcatgcagttttagggtattgtgagagataatcaacttcttttctggcacagataaatagagaagtatttccacaagcttaatagtcaccctgtctagattctggcttaaccgtcatactgaaatagaactttgccttaaaataggaacttttctttttatcttgtgccctctttgaagaagtaggattaggagaaaatgtacttttgcgtttactgtgaaccaatacttattagcatatgtgtcatgattctaggtcatcctagatcgtactaagaagacgtctataaaagcaaaggtagtaaatatttagagttggtggccacatgtggtgtctatcacatatgctttttttttacacccctttaaaaatgtataagccatgattagctagggagctatatgaaaagcaggccataaacaggttttggcccaaaggtcacaaatgccattccctgaccttaatggaacaaactttacaaaaacgtgagtggctcattgaacgtctctgtttatggcagagatgtgtgttttttcacacattgcctaacaagctaattgttagagattccaatgaaggattatttcaccaagatattggtgatttaaaatcatggtaaaatctaacattgtttggagattgttttccttaaaataacagataatggtcgttcccttaaaataatacatttctaaacttttttcctctaacaaatcatacacagattctttaagatcaatctctaactatatttgtcagtgacccagtgtccaattctgctttttctagtccacacaatccaaaagcattgaaagaacattttcaactaaaatgatatgtcaaggtgtcagaacactgatgctggtcagtttgtccttaagcatgccatacccataaaacaaaagtaggaacactcaactatgattgtggtcattgccttacagataacctctttctagagaaggctatgcagcttgcaaagaggcatgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataaggttaagtagcacaatttgctgctccatcctgctgctgtcatctgttggaatctgtagtagctggaggactcatctaagagtgaatctctctgggcaagaaaactaagatgtgtgtaggtaatggtactttttgaaaagccttgctttgtttattgaagtaatatttggagaattgttaagagtcctaccaaatccctgaagcattgttatcccagctgcatatttatgacagtgtactcaagaaaaagcccaataaaggcagcaacaacaacagaaagattaagagggactggtcattatttcccagttactggtttcttctctgctccctcttctgatggtcatcagtctatgactgtttcagacttttgtgactgctccagcccatatgtgggagtggaacattccaaacaccatgccttccattcttgctattactgagattgtatttgcaaagccacctggcttctttctaaaacagttctcttagtcctttcattgagacttctaaaatgatctcaaaagcctataaaaataacaagagacagcagccttcacattcaagtcaagtgccttatctaaaaccttcctaaaatagcatcaacatagagaaatccttttctgtggaagagctcttgagtgctgtgttttagacttcagtttaaaaattaaaccaagcactttaggaaagtaacaacctcagggtttcaagcagagacacctttgttctcattccttgcaacgtaaccaaggatgtggtataaccactggccttgttatacagtatgagaggaaccagtacaaccttcttggtataaagccatgaacagcagaattctttttcagggttaaataatccagttagcattcagtagcatacaaccacaagaaaaagcagttaaccaagacagtacagcagtgtttcaagtggcatttccagggacctgttaaattgataagtctaagaagatgagcacatacaggttagaaaggaagtgctgatatctgaagggaggattgttggaagggatacaaggcgaggcacatgcaagttccctcctaagacccaagcacactcacacaagccggctctcagagaggccacagatttgggacttggagagaccagaggatcctcataagagcataggtatagggcagcttttggccatcacagcccaagtctcttgttttaattcagctcgtcatatttggctaatagtttaaatcctgtggccattagtcatcatagaaaatataataaagaaaaatatataaaacttctgctattggggaaattcccataagggtgtgaggatttgagggggagggggaatgtacttctgctatgaaatgctgagcggcacatggaaattttcgagcagttttagaagtatgacctttttcttggtgtatgtgcatcatgtctatgtcagagtttaggcccttttcagaagtcttcttccagtatcacatttcaagaagcaatagtgaaaccctgagatcatccgttttaaaatatttctcaagtagcaaaatcacaatttagttttttaggctcttctgtgccggagttaatcccaagtacgatatacttgctattgctaaggaagaggcttgagtaaagtggcacctgatagcttattttagagaagatccagcctgtacctcgtgtcccagatgtagtgctgctgcgagatgctttagtgtgctctgcacctcaatctgtccatgctctggagtggtcatcttcttagacattcatctgaatgtctttagaacagtgcacatgtatcccctatgcaggattgcttaagggattaagagatggctttggagtaagacaggcctgggcttgaatcccagcttcaccacgtattggccttgactgagttatatgacgcctgcaagtctcagtttcattagctgaaaagtgaagataatattacctaactcataggattattgttatagtaaaaagacaatatatatcaaatgcttagcatagtctggtaaatcaaagctcccaacaaatagtagccactggtaaaatgattgttattgttattgttttgaattttaatagtatgttttttaataattaaaagaattacgctcctgtgagtgactttgacaccaccagtatgttcagcctcattagcgtaagctcttaagttccttctatcattcttatttttgtgcctctactgcatgctagggttgtaaggctgactcagacagaacctgccccagagatgacaggacagagaacgagaaaaatgtgtagaaaactgcagttgcataaccaagcagtaaatttgagagggacaacttgctccacctaggaggttaggaaagtattctctgaggatgtcaggtttgaactggaatataaaggatggagtaggcattgttcaggcagaagaaaggagcaaaaacattccaggcagagggaatatttgctggaatgtttgcaggagtggtgggaaatacaatcactttgtttcttcacaagtttactgcaagaattttcttccagtagttaaaagcttcactccattctccactcttgggatctggaaagatctttaaaaaaccaccacactgtattttggaggagggcagcagggctaagtgaggtaactaagtttttctgaacaattcctagtgccaggcattcattttacatagaatctgtgtgtcaggaaaagtcagggggaaaggtagagaagaaaaccgcccaaagccatggtatagaggcaggattgggatttaagcttaggtctttctgggctggaagcctcagtgtgtttatacatcaaggggtcaagacctgaatgctcccagaggccaggaaggtaccacaaataacgtagcagccttgggtaggcagttgggagggaccagtcctctggagacagcatcccacctcagattcaatgcattttatagattcaaaacattttagggccaaataaaactaggtatgagagcagattccattcttgagtctaatcacatcttgggaatcttttctttttcattaacattttagttaattattgccactgtgttttcattccagtgtcttacacttagcaatcatccaccttcattctcaacttgtgagggatctactagaagtcacatctggtttgatttctgatgacattatcaacatgagaaatgatctgtaccaggtaagcagaaatctcaagaaaacaactgaagaaaaatctgtagtttactttttcttctgttatgtttgggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagtttgcttgaggaggaaaaggtgtctttcaaaagcagaaagacagctccaagtgaggaaaagtgggaacaccagagttttgcccaaatcaggttttcttaggaattaattaggtgggctgaaaatacaagttgaggaactgttttttccagaggtcttccaacactgcaaagggagagttagctggagacacagcgaggccctttgatgggcatatgcagaattcagggagaggcaaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattattttaaagaaaattaattaaaacttcattttctttaaaggaaattaaaatatctattttcttatttttatttccattctttaaaatgtgctttaggctgggtgcggtggctcacacctataatcccagcactttgggaggccgaggcaggcggatcatgagatcaggagatcgagatcatcctggctaacatggtgaaaccccgtctctactagaaatacaaaaaaaaaaaaaaaattagccaggcatggtggcaggcgcctgtagtcccagctactcgggaggctgaggcaggagaatggtgtgaacctggaggctgagcttgcaatgaggcgagatcgcgccactgcactccagcctgggtgacagagtgacgctctgtctcaaaaaaaaaaaaaaaagtgtgctttaaagtgcatttaaagcaaaactactaaaacgtttacatgtggctcttaatagtttttacctgtgactaggtaaaaattaataggtttcctgataggggaaaatgaccatttttcattcaatataagtcaccattaggcttcttcactggctcttgtgcttcttgtcaaaggaaaagtaaagttagtgactcttcactgcctgttaatataaaataactagtatgaagtgtgattgtagatttacatttaaaggatgtcttcttgaaactttcataccgttttggggtcattggtatccgtaaggtcattttgcctgtaaagcttgattctcgcagacttttggctgattgttccttgtagtcatcacaaatctatgaataaaaccaggaatgggacattgtagcttgtcagtcctcttttcaaaccctgcttaacagtcatattcaaggaattacttattttatgtttataaataggatctgcaaaggacacagcacaacaggattagtagctgtgatttttttttggagacagagtctcactctgtcacccagactggaatgcagtggcgcgatctcggctcactgcaacctccacctcccaggttcaagcgattcttctgcctcagcctcctgagtagctgggattacaggcgtgcaccaccacacccagctaatttttgtatttttagtagagatggggtttcaccatgttggtctggctggtcttgaactcctgatctcgtaatctgccagcctcggcctcccaaagtgctgggattacaggcatgagccactgcgtctggccagtagctatgattttttttttatatcctaaactctttactgtatcatttggttacatatgttgagactctccagtgtgttagagacaaaaaccctgaaaccgccaccattgatacttctatcccttctgatttggggactctcagaagactatacgtccatttttcccctaccttaccaccagtctgattaatgggcagtgattctggcttccctagtatgccttctaggtgtcaaacacacacccaatggcaactttgatttgagaattagaaactgctaagatttgaactcttgattatctgttgtaaaggttctctagtaactattcttaatggaaaatgatacagttctctaaataatttggattatttgacagttaagcattcttcccaaatacctttcactaatctaagtacatttctgtgaccatctgtcatgatcaaattcctctccccacccaccctctagaaacacactcaaaatagtccaagtgcaccgagttaggattttttatgaaaatattctctttaagcctttttctcctttcattctccttcccccaacatagacaaccactctatcgtgtttggtatggattgttttatttgtgtatgttcccataaaacattattggagggttttatgtatttttatgtttttaattattatacatatcatgtatattcatagttttaaaaatggtacagaagaatctacattggaaagtcaaagttgcccaccctgacaatgcccaggtctgctagcacaaatgtcactattgtgtttataggtagtttttcaagtactggatacaaatgtacgtatacttgaaatacatagatattttcatatactctcacatacaatccacattatattaaatgtacttctcttgccttgcattaacctttaaaatttttttaatttaatttaattatagattcaaaggaggttacaaaaacgtactaggaagtcctagtatttactgcaaggaaaccagaggtctcttcacccagtttcccccaatggtaacatcctgcataacctcagaacagtgtcaaaacctggaaatagacgttgatacaatccacagatcttaatcagatttcaccagttttacacacacttgtgtgtatctgtatagttctttgtgcatatattttttaaatgcctaagtggcattgtgctacatgttactgtatttctgccttcactgcttatccacacagttctacatatagctagtttgttgtttcagctcctgaagagaatctagtatgggtctttcacctataacatccttgtttcctagtagtagacatttaaccaacttctaacttcctacctcagtagataatactgcagtgactgtcctcacttatgtcctcttgtggatttgtgtcagaatttcacccagatacatctgcaagagttgggttgctgggacatttgtatatttggctttccagaatgtctgtgtaagtccccatgcccacagccatagcatgaaggtataattgtttaagatataatccttggatttaagaactagaaggtttatatcatggaaaaccattgattggactgtggaagaaaatattaaaaaaaaaaaacctctccgactcataagatattttttaattaaattcaagctacagataatttataattcctgaatggtatactatcttataatttcagatccttttttcacaatctcattctctttccttttcccatctccccaagtagcatttcagaaaacacagattagtaaacacagtttccattgacttatttttgagaagaaggctcttggcaacaatatctaaagttttgaggacatcacttcatttcaggccaggttgatagtcctagaaaatgaaagaaataagggcaagtaataatttggcaaaaaaaaagggtcttgtatagtaaataatcactgtagttgagatttagactaccctcccatcattcatcctgccagttatcatgtgctgtggtcacctacacagctaggaggttggtggctcacctgctgctgtagccagtaactgctcaatgaaaagggaattttaggcaaattgtcacaagactggctggatgtcatagttaggctcctgtgaaataaactgatttgtataaagatacattgctgttctctgtcagtgaactcagttatttgaaagatacgtttgtgattgtatttgtcttactcatttttgaaaacacacagtttgcaaaacatcttatttgcattcaccgaagtaataccttgtgggcaggatagtcaaatggactatttaagtacctattaggtatcagcagctcaccttttttattcagctgagcccccttggtgagatacttgtattatcctggttatgttatttagaatcttataataccttttatgaaatgggtgtaggaaagctatattgactggtctcaggagccagtccatgggacagtattttttaatttagtaaatttagtttccatgtcagcatagaatcatggcacttttgttaattggtttctattgagtactttatttaaatttcttcagtgaaaacatagccttaatttgatttgttaatataaaattatcagctggaggtaactcctaccagatatttaagaaaactaaatttactactaggtgtgctcaaaatcaacaatcagtgggttgtagtgagaaacaagaagctattaagacttgtaaatatgaaaataacccaccacagaaaaaattgtaagtatatgaagtgatggatttgtaacttagcctgatttaatcattttatgttgtaaacttagattaaaacatcacattgtacctcataaatatatacaattactatttgtcaattaaatttaagataaataagaattttaaaacatgaattattgaatggctaagtgttagtacagtatatgtacttcattagcatatagtatggaacaggataacttgggtgccaaggtcagaagttaatctgggaatgagaaatattcctgcagtatggccccacctattgcagtaacagctaccaagctgtgagttgtaagtaagtattcactgctgaccagtgaatctcctgccctttcactttccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgatgcccatgtggacagtactacctacgatggaaccacacccctgcatatagcagctgggagagggtccaccaggctggcagctcttctcaaagcagcaggtaagatggtgatctggcggtcattaatgaaaaatgttaccaggaatgcaaacccaacttcaatagagcagtcatgttgccttctttaagccacagacctactgctgaaaaacaagggtaaataaaaattatatggcaaatcacattttatctgccataaggcactgtttggactagtaatcttgggctttaccctgatagtcattttagtttttactttctgattcatctgtttgtttggggtttgattgtttagattgactcccatgacaaagggtcttttcaaagtagagtttgattccttatagaattctgagtggtattagtctcagatcatatcagaaggccccagaagaaaaagattattggtataagaaatcatttaaagacttcattttgaaagaaatatctcttagaaattgaagtgtaggaaaaagaaaatgggccatgtattaagacccattatgtggaaggcactaaaaatggctagcacttattgacctttctgtgtaccaggcactgtgatatgcactttatgtgcacagtctcatttaatgcccaatcaccccttgtgacaaataccattattccccatcttagagtcaaggaaacagactagagagactaccagatcccacttcagggttccagtaagtgacagagctatgaatcacacttcggcagtgtgaacttcaagactttattctctgtactatgtttctctctcctattttgctcataggtttgcagatgttattccatttaattctctagtcctgtgaagtatagaaaattatccatgctgatctttgaatctccagtgccttgcatatttagaacctcaaaatatgtgtaatgaaattggcatctgaagcctgccctgacatatctgatatactttagaggctttttttttttttaacttaaaaggtaaatgcttcataaattcaagaaaacaaagcaaaagacataggaactttttctttgggacaccatatttttcttttctcttttgttaaatagaactttttcttgaacaagaaactctgattgcagtgggtattaatagttttagaagacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctcaaaaaaaaaaaaaaaaaaaaaaagcgtcagttaagagatagctcatccctccacactttggtcctgtaaattgttcatcttaatttctccatggattacatttattgcctcatagatcaggccagaactgggagaataaaatcaagaaacagcatgaagatccttctttgtttcccattaagtactcctctattattgatattgacccatctgatgttctcccagcaagataaaaacaagttcctccctcaaaaatggcatcattagacatcaagctaaacactcataaaaatcatctaagcctctgagaagtaactctagctctagtctttgagttactttgatgttttgtttatttgtttgttgtttttgtttttgctggatgctaaagagcagactacatttcccaaaatatttcaataattatacatcctagtaggtttgtttatttaaagatcagaaccctggcattgctgtacccagcaatgaaactggccatgctgtcactagacatcaagcatctttgctcttttgagtgtccaagaaaaggggctgagaaatacacattgtcatgcataaatttgaacagttaggaccctaatcctgagggtgcaccctagtggctgtaatcatgctgtccatcagccctaagattaaagatgcactattcagttgagaaatatcctgtagagttaaatgtgaaagagtatttgaagtctttttttcttcaatagtatctttggctatttcaggtgtcataagacactttaacaatcaaagtaaattacaattttaaaataatttctctggatattccagtagaaatgttttatgatttaaaaattatccaggagattgcctcaagctgctacattgctttgcctttgggaatctgacctttgcaggcagttggaagttgacaagatctgggtttacctaatgctgtgtaatctaacttcgcaggagcagatcccctggtggagaactttgagcctctctatgacctggatgactcttgggaaaatgcaggagaggatgaaggagttgtgcctggaaccacgcctctagatatggccaccagctggcaggtgagtgccgctccatctgtctgatggctgcccctgagggagtcagaggttcaggaatgtaagaacagatggtcttcctggtgctttattccccaaagaacatgccttttatttttaagaaagtctgtttgtcagagaccatttttatcttgaaaaaccctatccatgaaagatctaggtcagctgagttctgagtacgaaagtgtatgcctaatcagatcagagttgagatgtgagaaaaggttagaagaaaaacacaaaattcacataaaagttacccattccaaattcacaccataattgtgaccatctcaatttctgaagctaggataaatgttactgtttgcttaggacttaggtaagtgatttcaggatgtaaaaataaactaagaattcttcttagaatttcaataaatataaacagagtaaatagatttaaagccttcctcaaaactccacagggctgagatctgaaggtataaagcagttactaggtcatttggccccaggaagaaaagccagagggaggaggtgggcagcatgcaagatctccaacatgacaagatcagttcttctagagacgagagctgctccacttctaaaactgctcatgtgcctcccacagcctgtatgtgtccagctcactgacgttagcagagactccatggttctccctttatgttagcacctcatttccccagaaggccttgccacagaacacaaaaagatgatgcactcagtgaccccacgctctccttacccaggtcagccagcaacagagtgactgcagagaacaccacaaatgcctcggcagctacagaataatttttcttttagcctaagacaattctggaccctcagttaaaatgtcagtattgccagagggttaacaccaagccttgtgaacatctagacatctcaatttgagcaagtttatacaattcattctcataagcttgttcctatggaagaagggagacagcttcacagctctgagtaagctcttcactagccttaggtctctgagcaggagatgattgacatggtggcctggactgcctgttccttccaaaaggctatagctctgactctctgcagtttggttgggtattctgacccagctcagagtttgtgcaaagcactatttcccagtaccagagcccctacagctgttcttcccccaaagggtaccatattcttggagggtggtcctgattcctcttgccattcctccatcattaggtaccaggccctcctaaggaggacatgctgagttgtttattataaagaaacagactgccctagtggtcccttcgatgtataacgatttctggtgtttttctttccaacaggtatttgacatattaaatgggaaaccatatgagccagagtttacatctgatgatttactagcacaaggtgggttgtgataaaaccagattctcttaaccattattatctccacactgtcatttaaagggaggaaccagcattatccagggtctactgttaaaagttcttatttcagaaccaaaagatgctggaggtagataaggagaatatccagttttaatctactgtaaatgtatactgccttctactcagctgggctttgaccttcaagtagagtagcttggttggttccactgggagttggacagcaagccaggcagcaatgatcagtccctccagagtgtctatggcatgttagaacaagtgtgttccttcttcatttccttcaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtaacaccttaccttacagatttagcaattttcatttgactttactctgttaacatctctggccagggcataatctccttcccttttccttaactctgaagaagaaaaccagtcattgcccaaggcctgggagggtgacccaggccaagttggcagcccatcttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatggggtgaagttttctgttgaaaatttcatggttagcttttgtttctgcatggatttcagagcttcagcttacagagggagactgtgtagacgtcactgtaggcagagtttcactgcctcagcgcttctctcgctgtctctctctctgcttactacaaaccacttctctgtgatttcctgagtggtctttgagccgaaacaggaaacttgattcgaagactgtattttcttagtcgctcttctctgccctttccatttcctcctggctcctgagtggaggaggcagcatggaagagggaagggtgggctgtcagtgcttacagcctgcactgggactcgaacacaagaacatgctcctccttcctttctttctcacaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaataaatactaaaaacaacatgatgtgggtgattaaatttaacacatgagagaaataatatttaccttaaagagagaaccatctccttcttcctttgcctcctctctcaagcttatgacactgaccttgtcccccaccatatatgggactacgtgtcatgccaccaaaagtctcgcaaccatatgaaatggactctcaacccagcccagtaatcctatatttcctacaattttattctcccactctgtaaatgatgattccatgctttctatttctaaacccccaacactccttccctccccttactcatgcaacacccttgcttcacactctgttgaaaacagaagaaaccagaaccctctcacctttgcaccaagtgccagcccacctgtgcctgtgcccacattggcagccttccatccggacttggtgggttaaatttctttgcccagctgaggagccacctctcccctgagtctaaccccctcacctttactaggttgttgttcctgttaattcttacctctctctcctgtactagccgttcctcctccccactctccgactaggtcacctagcaagcatttcatgatttcctcatctttaaaaacaaaacacaccgaaacaatcaccctcttgatcccacatcccatttagctacagtccaattgctctattcccatacatagcagagctccttcaaagaattttttagagttattctttccagcttgccaccttccaccctctgcttggcctcctgcagttgggatcgcatccccaccgctccaccaggcctgctgtcctcacagtgaccggtcacctccacattgccagatctggtcacctccttttcaccttgaccacttgcagagtgtgtcatggttgacgcctaccttcaacttcagaccgtctccattcctggctcctccacagcacactcccctggctggctcttctacactcaccttttaaagtcacagccctccagggtcagtcctaaaccctccctgcttggtacctcacccaagcccaatactggctacatctgtcagaagcgctgccatcttccaggagattaagacaaaacccaagaattcctcaggagtcctttctgccactaatcacttcgtatgcgacgcatcgagtgtcatcctgtctgcaaccaccgccccaggccagcctgccgtcatttcctgcccaaattcttgcacggctcctactcagtccccttgtttccttcctgtccacctcccttcagtccattctctgcccaacagatggtatgattcttctaaaaaatcagtgacattgtattaattctgggttatgcccttcagttcattcagtcattcattcagcaaatcctgatccagcatacactgtgtgcctagcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaaaaagaaaaaaagcaaatacttaacatttttttaaaaagtaaatacctaagcattaagcccttaatttgtagttatttttaggatatcgcatagtttgtaacccataatagacaccaaataaagattggttgattaaacaaatcagtcaataccaaaatgatagtcgtgccactggcattaaagtcttaatattctaatattggaatttggtacataagaagatagcattttgattagtgtatgttagacttctgtttccttcctcactgtataggaaataatttgtcttggtcatatccctaaggacacttataaacaaagggaattcaacctgattttccagtatagactcattttcaccaaaatcattttacttttattgctaccaaaaatgttttcaaggcaatgtatgctgtaatagcatatgaggcccagagagagatctcatttttagttcttgcttctgtcaccaatttattttgctgaggttcagcagtttccccagctatgaaatagataatacagtggttggaaaactacacttgatttctaagggaaaaaaaggtccactgtgagtcaagagaattcagaaaggattctcataaacacaagactagattgcaggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctca

SEQ ID NO: 490 - DNA, 115991 bp, Homo sapiens; identical to SEQ ID NO: 489

SEQ ID NO: 491 - DNA, 83529 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgcc

SEQ ID NO: 492 - DNA, 92605 bp, Homo sapiens
cggtgattcagaactactaaacatttattgaatgtgtaaggtattaaaaacatttacaattttgttaataaaatgatgttttatattaatgtatgtattatgctttggaatatgctaagtcatgtagataactttacatttctttcaataactttattctttacaaaatatacaaataaataaaacaattcaacttttaaaagtattaccatatgcaagaagaaggtattgctatcaccattctaaattaccacaatgcattcatttcctgttcccttatctttcaactctagtggcaaagtaaagactgaattgaaattaagctgcactacaacatcattaccagggatagacacataaacaaagtcatttccaaataaggaatgctggatctccagagaagtgacaaagaggagtctactgagttttgcactcaggcacatccttgcctgaggaggcgtgccaaggacctggctgagaatccacactctctgctcctgcattttgcacctctgagaaagaaaatgaaaacaacattcatcctattacaaaaatacacaaaaaccaagcacagctggaagtggaaaggaggttaagacaggagagatgtgaagaatgaaaaatggcaacgtgattcaccgtgtttggtcatgaagatggtgtatttcacctcagagttggagaagtttactccccattttgtcctaaaatgaactattagacaaaccatagttaaactgagaggtaataaagttttatttggaattcttcaatttgaaattcaaagtgaatcaaacacgggctgattgagttttcttttgtcctgtttttcaaaataaatggtgtgctaaacaaatagtattttagagaatatttaatcatctttggaaagctttctgtgagcctttaaaaaggactttagctgcatctatttgcttataaacaatatttattttacaattattatatttataaaagtaaatctaccataactggtcttggcaattaccttagtttaaggtaatttagattaccttttataattaaaagtaaaaactcacatttatttttttaaagactggtattaattcaagctgggactatctcatttaattctgaattggtcagtttttgatttatgtattcttctaggctactcttttatttatctaaaaacagtaccagagagatccacatattaaaaaaggactcaaacatttttatttgcagtttgatgaattcacattatgcatatgcctctggcactagcagacaaaatcaaaaggtgattacagctgggtgtggtagctagcatgcacctgtagtccttgatgcttaggaggattgcttgagcctaggagttcaaggccagtttgggcaacatagtgagagagttccatgcaagtgttagctagccaatagaaggtccttaaatgtttgttaaatactatttaatgaagagaatatttcaaacatgtttttattccaaatgtttctgtgcctacctatctccctaagaacacttttagactgtcaacttgatctaattttgatgtagttgatgagaatggatagattttttcttaatcacaaagtagaggtttataaactctggcaaatagtgctcaaggttttaaatgatttggcaactgcctttcttactgtacaattttgttgctttagatttctacagttgcataacagggtacctctggtagggtaggcagacacactgtcacaaagggctgtgcacagtagatgctatgtggtgagaaagactacaagaaatgccgtgttaccgtttctcctgcaagtccccccacttctgtggacaacctccatgcagagctgggggtgatccttgatacctccccactcctttgttcaatcaggtgcctggtgttgctgattttactccaaaatctctcccgtcggtctacttctctccttctctactccaagtccacactaccatcatgtcttgtttagacaacagtctaactcctgctcctattatttgctggtcaccttagagacgaggtgatgttttcaaaatgtataactcatgttctcctgccattgcttaagatctttcaaaggcttcctctacacaataaatgaaacaattcctttatataatttataaaagtccagcatttctggctcttatttctctctttggcctcactgacttcacccacacaagcttgtactcactgtgctctgaccacaccatatttctttcaactcttcccctggtcatgttcccacctaccctaacgctgttgctgttccatctgcctgagatgtttttccctctgctctttattaagataactcatgttaaccttttagatctgatctgtttccttcctcaatactcctcaaatacttattatatttctcatagtcttttgtacttgcactgctataatttcacttttttttttttttaatcacttgattactgtctgtatcttccatgagaattaagctctatgaaggcagggatcatgtctggttttgcttatcaatgtgccaccaggatctaatccttaacacatagtaggggctcaaaacaattttattgactgaataaatgaataagtaaatgattcatctattatctggcttgggtaaagtaaatataatgctattggatattttggtccattgaattgataagacttttcagtaaaagttgctttttagggtagtatcttcatgtccttgagaaagttgcttgtctctctttggacgaaactaaaggcttaaagggtagactaaagacttcacttggggtaaaagtgaattgcacttcactgtgtggggtgccttggagaaatcaactttcttacagagtcagcaaatgaagcctgtcattgtagcttactcaactaaatcatctcttatctaaacttgccctttgggatcacatattaatgataagttccaactgttaccctctgatttccaagtaaccagtatatttacttacctggacaaaggcctaaacttgagttatcaaaatagcgaactggatgaggtgatggtaaagactttgatcggctatcaaaaaaacaagattttggtgattcctttggcacaggatcttgtaaattccgttccttgcattgagagggtgtaatttgtttctttttagaagctgttccagtcactttaggagactttggagaattctcacaagttacttgtttgtgagcctctcttttaagggttctttccttccaagttttgacctcattggaaagatgctgattattgcttaaatgtgggggaagaaaagagagactgtaagacttcttgattcttaagatgtattcacatttatatttaaaaattaaaaataaattgtgatgaaatatatataacataaaatgtacattttatcacatttacattttaatttcaacctcatgcttcctgttttgactattttcaaagttcagaaaacaaaatggatctatataaattgaataatatagtaagtttccatgatcatggagtcttgaaaagaaagctctaagtacaacattaggttttcaaatgaatcaatgatataatccagagtggcttatctattgatgctttgccacaataatttgacaaattagtctcctggatagatgaatctttgatgtacctttcttactgtaaaataaatattacactgtgcttttctagttacaatgctgcttcttacaggagatgccaccagcatttatccagttcctccggagagaaacctgggaagcaatcctagagacctcactctcttttattttaagtcatccaagtctcttgatacactctcatcctatctatcaaattcacttccttgtttttatccctattggggccaagctagtccatgctaaaattactttttgtctgaactaccataaacacattctaaaatttgatccctctataatgctctagcagccaaagatgctatatgatctcatcaggccactagcttaaaaccctccagtgcaggtaatcctgccattacatttaggataccactccatattcttcaaaatgaactataagggcccatgtaatctgaatctagttacctctggcaccttgtcttgcactttactctgtctcattctctacattctggccacactggatgtctttcagtcccaccaattagttattcttcttaactcaaagcccgtgaacatgttcccctggcctggaaaacttatccttcttccctcatctagcctaattcctactcatttttcatatctattctgatataggcataccttggagatattgcaggtttgtttccagatcactgaaataaagtgaatcgcggaaatcttttgggttcccagtgtgtatagtagaaagataagtgcaataaaacgaggtatgcctgtttgttggcttcctgatcaaccaaccctccacccctaacacctagataacgttggatctctctctttcataatataacccttttataatgtcctttttgtttttgtttcttttttaatagcactcatggcagagttagttatttgtaaaattatttaacgcttttttttctactgtatcatagtagagtgcttggggaaaagattctactcttccacgtggtagaagccgaataatttgttagatctgtttataaagtaaaaagcctacaataatggacgtaaggagttcctctctaagtaaagcctcactggcttgggtatatggacttgtggtgtatttcagctgccccctcaaaggtctttgtttctttcctatttcttgccttggttaagaattggtcagttgatagacagcaaacattggaatagtgctaccatattctcattttttaaaaaagatacttattacctgagctctaaaaattactttccccataatgactgaagtgttaccacctgcaaaaaatacgtgcatataccatgtccctacatatatgtaatagccgtaagcataatatccgtatcatgtaagcagatcttaccttaacaattcattcttttgttttattagctgttcattttgctgctttaacttagaaatttctttttctagccttatatgttcacttttcaaaataagagcttttgtgttttgtacaatgccgctgccacctccacaagttaagggtttatttgaaggctgaggatcagtatgttctgatatcactgtgggaggaaaatatacaaataggtgataattttaattgtctccaaagttcaaaataaaggaaatactaccaagtacaataagccattatagagacccaaacagctcaagtcttatttccctggaagtcacccttgacttctgccttctaccttactccctctgcttatttgaccaaccattaattctatgcctctagaatccccctcaaccaattccactaacatatcctgatcctgatcaccaagctctttcaccctgactgcagcaatagcaatcctctccacttactgctgtcctttattgatctatattttctacatcagttttcccctgaagggcttgttacaacacactgcgtgtgtggcggggaggtgaggtagggtgggagggccaccccgtcattcagtgcattatatgtattcaatacatattattaactaaatatatgttacaataatattaaagcacatattaaatattctacactatgtgtgtaaagagactgtgttttgtaaattgtaggcaaagttgcacaaaatgtgagatagttatgaagtggattaatccattaggtcactgggaattcacaaaagagggatagtgtgtgtgttgggggtgattcttgatgtctattttattttgaattcatctacactatgtacctgaaagtcatctacaaatcaagaataaatatcctcaaccttctgaaacaaagaatcctcacttctatttttacccctttaagttttctcggtaggtgctgtggttatcctgtaacagacactagggaagtttaagctacaacaggtactaggtaacaccttaacacctttagcaccatctatttttggaaacaagtggactataatacaagcaaatatcatcttatgttttgcttagtatttggaattttcaatgtgtttttacccacaactttcggtttgatctttatgtacgtgtgtgtgcgtgtgcatgtatataaataagtgtatatgtatatacacttttttaaaaaagacacttattacatgagctctaaaaattactttccccatgactgaagtgttactacctgcaaaaaatatgtgcatataccatgtccatatatatgtgtgagcataactatatatatgtgtgcacatgcatatatatgtgtatacacttatatgtatcctgtaacatataatatacagaattctatatattctgtaaatatataagtattatatataatatatattgcatattgaaaattccaaatactaagcaaaacataagatatttgcttgtactatatacttataagtgtatatatatatacacttatatataagtatatatatgtaagtatatacacatatatacatgtgcacgcacaaatatacacttacatatatatgtatatacttatatacttatacatacatatacttatatatacatatctatacatatatacttatatatactaagtatacttatgtatacatgtatatatacacatatacatatacatatatacacttataagtatatatgtgtatgtatgtatatatacttataaatgtatacatacttataagtatatataagtctgtatatatacttgtaagtatatataagtggatatatacttataagtatatataagtctgcatatatacttgtaagtatatataagtgtatatatatacttataagtatataagtgtatatatatacttataagtatataagtgtatatatatacttataagtatataagtgtatatatatacttataagtatataagtgtatatatatacttataagtatataagtgtatatatatacttataagtatataagtgtacatatatacttataagtatataagtgtacatatatacttataagtatataagtgtacatatatacttataagtatataagtgtatatatatacttataagtatataagtgtatatatatacttataagtatataagtgtatatatatacttataagtatataagtgtatatatatacttataagtatataagtgtatatatatacttataagtatataagtgtatatataagtgtatatatatacttataagtatatgtgtatatatacttataagtatataagtgtatatatacttataagtatataagtgtatatatacttataagtatataagtgtatatatatacttttaagtatatgtgtatatatacttataagtatatataagtgtatacatatatatgtatatattagaaaatccttcacagcagttctgtttattctcctgtaaaaaagtatgtatgagtatataagtacatatactcgtatatatacttctatagacttataagtataatacttctaattatataagtatttactatatatacttatatattacttatatatattacttacatattacttatatataatatataacttatatattacttatatatgttatacttatatatattataatatatattatatataatatataacttatatataatatataatatataagtaatatatattttatattacttatatattactcatgtaagtaataaagaagtaatagatatattacttatatattatacacttatactatatatacttatatatttattatgtatacttatatatgtataataagtgtatatatacttataagtgtatatatacttataataagtatatatataagcatacatatatgcttataagttagaaggtcaggtgctaaccccacgatttcatatagccattgagatctgcatcttagttcagtacttgttctactgcgtaaagctatctcaagtactgttcaagcattctttcttttcaaatggaacatgacagacagaatatgaataaaggtagtttgaggaatgcatgtatattgagaaatttgaccaacagatctaaaaagtatctcagataaatttcaaagacctttgcaagtaaatattaacttggtatttttagtttcaagaacaaacagaatagtatttatttttactgtacaccaattataacttattagatgcatacaattaaaatctacgaagacatgtgtttcgttttattgggaagcataattccatgttgatatagtataagtcattcctttattgcctgaaggtatcttcactaataggtaaagatttgacaatacaaaagcagagttcgtatttttcaagaatctataatggataagcatctaagattacaacaaacgatgtcacaagatatctggaaatatggttccaataaattcatttaaaaatagattagtggccaacttctgtttactctcgactgtcacatactacataatattagtcttcaaagtctgttgtgtgttgagaagtaaaatttcatctgaaaatatctgcattttctacttacctgaggtatcttgggcctgttgacttcttctgagattttctctcaatagccttataacttccttttgatattctacagtggcttttgtagcactgattctaacaaaaacaataaaaatatgtaaaaagctcagcaactgattttttacaggagaataaacagaactgctgtgaaggattttctaacacatcacattgacataatgcctgtaagtggcagtagataagccctcgtgatacctctctggtgccatgtgccttatggcattaatgccatcaaactagaagcattctgcttgggtgcagggacagtccgattttcttatattgagaaaccccagttcttttaaagcttctggaggcctaattcattgtatattgaacaaaattataattacctaattattttttaccatggggtcctagaaatatttgaaggtataaggagcatgaaagagaaagtgcagctttatttctgtatggtcaggaaagcaaaccctgactgcagctctggtctaaggtgctacaaaggtcaaattctgatcactgttctccagtagaaagagacattttatgagttgttagtttacgcattaatcagtaacgataaattataagactttctgcctttcttaatgactatgaattatctgtatctgctgaccctattctttacttttcttttctttttttttttgagacgaagtcttggtcttgtcccccaggctggagtgcaatggcgctatctcagctcactgcaacctctgcctcctgagctcaagcgattctcctgcctcagcctcctgagtagctgggattacaggcacctgccaccacgcctggctaatttttgtacttttagtagagacggggtttcaccatgttggccagactggtctcaaattcctgacctcaggtgatctgcctgcctcagcctcccaaagtgctgggatcacaggcgtgagccaccgtgcccggccctgctgaccctattctacaagtaaaattgtttttataattaagaatctaatagatctatgtttcactgaaaccaatagactgcttagagagcatgaaaattccaatgctacttcctgggcaaaataagagatcattaaatatttattcaagatttatataggaagaatgaaaagtgttaaaagccaggaagcatcctaacaaatcctctaaataaacctttccttattgattatgaatgcgaggaccagagagaataaacagtgtaaggtgatgcattagtaagtgagaacatatttctttttttttttttttttgagatggagtctcactctgtcgcccaggctggagtgcagtggtgcgatctcggctcactgcaagctccgcctcccgggttcacaccattctcctgcctcagcctcccaagtagctgggactacaggcgcctgccaccatgccggctaatttttttggtatttttagtagaggcggggtttcaccgtgttagccaggatggtctctatctcctgacctcgtgatttgcccgtgtagccctcccaaagtgctgggattgagaacgtatttctacttcagtttccttgactctctttaatgttcttttcattatgctataccacaaagaatttaggcatgctgttatgtataatgctacctataaataaatcaataaaaagaggatttgctcttgggccctagggaactataaactaaaaggaaatataatcttcacacagaaacacagtaaggccaacaaatgaaattaagagaaccaacagaagccttagtaaaactgctaaatacacacacacacacacacacacacactcttaatgttcactttcaggcatacaaaagccacttaaaattgtttatattctgtatgactaagaagtgttcaaagacacagcgtgttaattgatcagaattgtgtttagttttaaaaactttgcatatgtaatgagaccagtatatttaaaatctatggatgtgtacatttttaaaaaaagagctgtaacaatattttcataaattatattttaaaaagttaactaatgaaaagtatatgtagtttaggaagaaaatttaagctattaaaatcacattaaattaagacaaatacgtactccttttcaaattctttggcatttttcattttctctaggtctattttcacaagcttcattttgagatcttcaatttcttctttatatggcttagctcctaaagcaactttgtcctaaattttttttagagaaaataaaaataattattagaggcgcttcagtttctccagttgtaaagaatggttagctgtctttgctctaataaggacattttaaaatagcaaacaattccaaatatatgaaaaagcatcaattttaactgaataactagatattgatatgaagtctatttgaagctaatatgcaattagaaacatgattttttatttggagctatcataatatgcaattagaaacatgatttttatttcttaaaataaatattttttttctaattgaaaatacctacaaaatgaaaaaagttggaaataatgaaaagggtggaaaaaggtaaatcagaaaatgaaacaaaaagatgttggagcagtgatgtaaacatcaaactagaactaaatttaagccacaaaacaaagcattactaagtatattttgtactgaaacagttccatccagtgattcaaaacactatattttacagcagcaggtttccagaaaaatggaatggaaaatactgggagttcctacatacccagtgtcccctattcctttttccccatattaacatcatgcattagtatgctgcatttgttataagtgatgaatattgatacattattattaaaatctataatttccatgacagtttatttgtattgtacattctgtgggttttgacaaatgtaaaatggcacatgtccatcattacagtatcatacagaatagtttcactgtcctaaaaaaccccgtgctttgcctattcatccctctcttctccattatccctggcaactgtttatttttttactgtctctgtagttttgtctttctaaaaatgtcatatacttgaaatcatacagtatgtagcctttccagattggcttctttcactaaccaatgtgtattaaaagtccactcattttctttcctttttttttttttttttttttttaagacagagttttgctctgtcacctaggctggggtgcagtggtgcgatctcggctcactgcaaccttcgcctcccgggttcaagcgattctcctgcctcagtcccctgagtagctgggattacaggtgcttaccaccatgcctggctacttttttgtatttttagtaaagacagtgtttgccatgttggggaggctggtcttgaaatcctgatctcaggtgatccgcccgcctcagcctcccaaagtgttgggattacaggcatgagccactgcgcccagccctctcatttcttttaattgctgaatactattccactgtatgaatgtaccagtttatccatttacccactgaaagacagtcttagcaattatgaacacagctgctattaacatacacatgcagccctttgtgtgcacatatattctcagctcatctgagtaaataccaaggaatacaactgctcaatcatacaagtatgcttagttttgtaagaaactgcgaaaccatcttccaaaatggctgtaccattttgcatttccactagcaattaatgagaattcttgttgctccacacaccagcatttggtggtgtcaatgttttggattttggctattctggtaggtttgtaatggtcgattattttaatttgtgattctctgatgacatatgatatgaagcatctgttcatatggttatttgtcatctgggtcttttgccaattttaagattgattggttgtttcctattgttggttttaagagttctttgtatattttgtataacattccttcaccagatttatcttttatatacagtttctgccagtctgtggcttctcttgattctcctgacagtgtcttttgtaaagcagaagtttaagtctcaataaaatccaacttaccagtttttttctttatggattgcacttcttgtattatatcttaaaaaatcgccaaacccaaggtcacttagaacttctcctatgtcatcttcttggagttttctagttttgcattttacatgtatgcctatgatctattttgagttaatttttgtgaaaagtataagttctttgtctttttttgcttgtggatgttcagttgtctggcatcattagttgatcagactatccttttcccattgagaagcctttgtttccatctctcccagaatagaaatgagagttcttaaaatagcttacagggcctttatgatctggtcctctgctacttctcaccttattttctacctctatcctcttgcttattctgctctggatgcacaaactttcttgttgttttcagtttgctatttcctttgcctggaatatttctccctggctacacagttcaccctatcacatccttcagatcatcttactggtgtgacattcctcaactcctgtatatacaatcatctctcttcccacacatgtccactttcacccagaaccatgtacccccttgtctggcttaattttttccatttcacttttcaccacttgagatataatatacctcttaatatatataacatatataaaaatataccttctatgttttacatttttaattaatattctgtctccttcaactagaatgtaagttccttgatggcatggtctttgttttttcattggcctctagaacagtgagtgacacatagctggtgctcagcaaatatttgttgaatgaataaaaactgtgatcaattatttgtaatattaaaaaattacaacattctaaaactttacagttgaatttttttagtttctagctataacaattgttgaaaaaacaaatttaattttttcttttgcctctctgctcatgtctcactgaatagaccagaatttttagaacaatgttaaataatgaataaagcaggcattcttgacgtgttcctaattttaactggagagaaaagacactggagcagaacagcaaatttaaatatgccaatttggatcagactcgagtagaagaaatgtgggaagtggctggaactaaaacaagagggagctgtaagtagtgattaatgagtgtgtgatttgtctaatgacattcaagttgaaaaacatttcagttacggttcttccccccaaaacaggtcagattcagcccatgggatatcaggtgggactcagtaacagaggcagtaagtaggaaaaaaagaatttaaaaatttacttatctaatagtattatatattttgataagcaatttttgaaaaatgaaaaaatatacactaaactataaacaacatgtatatcttaaaaattattcttccaacataataaaaataatattttatatgacaatatgctcctacatttcacttctaagttaagctgcttctgcttgagtactgaacttcagaaacacataggtaacagtaagttgttgtgagagggaagaatagagcacaaggagatttgctgaattcaataggttaaacaaacaaacaaacaaacaacttttatttttatgtttaagttacctgaagtacttgaattgtctcttttgttttttcaaggcatttatttgattcatgaactttggcttgaagttttgctattatgtcattagtcacctcaagttctttctgcatctttataatcttgctttccttatgcatagcactttctttagcttcatgcagtgaattttccagctctcgaattttctattagaaaaagcacacattcataagctctatcatcaagacagaatcacagtatagaaatttgagacagagatgatcatatttagatattgttaatttttcacagattgtattaacaatggatagaagagaggccaaacatcattcaatctacagacatgttatttccctcatttagatgatgatttttggattgaaaatgtcaaaggtttatattataatctgtctgcaaattcttaaaacatgcagttaaaaacagcacagtggttatgcgatttattagttagcatagtgctaagcatattaaataggcactcatattttacatgaacaccacttaaacaaaggacattggttaattgactctctaaagtaatatatatttatctttccctttaattttattaattttttttttttgagatggagtcttgctctgttgcccaggctggaatgcagtggcgcaatctcgactcactgcaacctccacctcctggattcaagcgattgtcctgcctcagcctcccgagtagctgggactacaggtgtgtgccaccacgcctagctaatttttgtacttttagtagagacggggtttcaccacgttggccaggctggtattgaattcctgacctcaggtgatctgcctgccttggcctcccaaagtgctgggattaaaggcatgaaccaccatgcccacccttattaatcttaaatagaaaaacacaaatatgtggaaaaaaattcaaagacatataatgaagagtaagtctccccatctcagacccccagttgaccctgaagcgatgactactaaactttttcaggtgtatccttccagaaattttctatctataaccaaatatacatgaatatatagtttctaaaaatagtatacacacaatatactaaatatagttctgctttattttaaaacttgagaacatattttttccagatctttccattatcaacacatagatctctcctattttttgttttcatggacatatagaatctcatttcataaaggtatcatataattcacatgtacacactcttttttgtttttggcaaaatgtctggatttttgggggcccatttagaattcatttttgtttaatgaatgagataggaatccagccttacttttttccagatggctatcctgttgtatcaaaataatgcactaagcaaaccatcttttctttctttctttttttttttttttttgaggcagtgcctcactctgttgcctaggctggtgtgcagtggcatgatcatggctcactgcagtatcgatctcccaggctcaagtaatcctcccagctaagcctcccacatagctgagaccacaggtggatgtcactgcacctggataatatattaaaaaaacacttttttttttgtagagacagggtctcactatgttgtccaagcttatcttaaactcctaggctcaagtaatcctccaaccttggcctcccaaagtactgggattacagactcacacacctggccaagtaaaccatttttttttcccactgaattgaatgttactgttatcatacacctgtactaaattctcatacttaattgggtatatttctgaaccctctattctgttccactgctctacttgtccatttttgcatcaaacttgtctaatgatagtagcatgtattttattatctgctagactattttctttggtcattgaagattgaccaactttccttttgcttctttaaattactatattggtagatggatttcatctttcctctattttatctgtagcagctgactgaggtctgtaatgccctacaaatcaaaacactgtatactagtgatctagttctcattaagctggtggttgatgttttattataagtatttattttggtaaaaatgataaattgtaatttactattgggttccctacaagtcgttttgtgtgctaacaaaatacaacattttacgcatgttgttagattcccgagtaagggtagttaataaggtaatttggttatcaaataatgtactggttcttagatacaagttaacctgcgtaacaatcttgttatattttttaacctcttatatttttattgtgattataacattaagcaatattaaatacgctgatgataatgagaaaagctgaattgctatttctctccaagctaatatttgttctgcatacggacatagatcacagttcaacagaaagtcacataatttggaaaacttttgtggtaattgtacgttaactggtagtaacttaaactatagtttatgaatgtaataatcaaatgaagctacaatttatgttttataataatatcttacataatgtctagctttataattagtttagttgaacgatagccatagtagaactactagtaaaaatcaagcccatcacttacaaaaataaatgtgttcatgttcagtaataagtaaatactataattttgctctaaactctgtgatgaagctgcaaactgaagaacattttataagaaattatatacctctgtggttaactgtgtagctcttgatgtaacatgaggattcttattgtcttgtgtggtaggattaacctgggcaccagatgccaaggaagtcttcaatgtttggtagtttttaaatagtttttcatttttctctttcagtgatttcaggtcctgttcccactctttggatatggtagcacttctttcctcaaactctgttgattcattcattatggcctattgaacagtaaaataccattatagctctaaaacgatttatagtagtccccacttacctgcaattttattttccatggtttcagttaccctcagtcaaaagtggtctgaaaatattaaatgggaaattccagaaataaacaattcacaggttttgaattgcacatcattctgagtagcacagtgaaattttgagtcatcctgctcagtcctgcctgggatgtaaatcatcctcttgtccagcatacactacttgttcacttgatagccaccctgattatccgattgctgctgtattgcagtacttgtgtccaagtaacccttattttaattaataatggccccaaagcacaagagtagtaatgctggcaatttagatatgccaccgtgaagctgtcaagtgcttcttgtaagtgagaaggtaaaagttctcaacttaataagaaaaaaaatcatatattgaggttgctaagatctatggttagaatgaatcttttatccgtggaattgtgaagaagggaagagaaatttgtgctgtttttgctgtagcacttcagcctacaatagtgtgtgataagtgcttagttaagctagaaaaggcattaaatttgtggtagaagacaagaacagaaatgtgttccagttgatgacaatgtgttgtaccagcaagcattgagcatctaggaagacttcagcaagggatcccctgaaaaaagtgacaccaagccctttactgcaagtaagatttattcatggattcaggaatacagaaggtcaatagtagtctaagactatatcaaaatgtctaggtcattcatattccttcatcttatcaggtaggcactgtatcatctcacatcataagaaaggagagtgcagtaaaataagatattttgagagagtccacattcatataacttttactatagtatattgttaaaattgttctattttattagctgttgttactaatctcttactgtgtctaatttataaattaaactttatcataggtatggatgtatagaaaaaacagaatacatagggtttggtaccatccatggcatcccctcgggggtggggggtcttgatatacatattttaaaaaaacttcaaaaaaccctagaattctaggacagtgtatatgctgaagttcattatttagaacattctaaaacagtactttaaaagaatgtgaacattctttgtagtttgcatcagtttctgaaatttcagatgttggatgtggatgatgacaataaaatgaataatgactagagaggattcatattgatctgcaagatgataatctcactttattagatttgtactaacatatgaagagaacctgaagaattatccaggttaaaatcattatatatgctatggctgataatgaaacattaactgatatctaatagcagagcacagctagaaacttaacaattatctattgtcctgcttcattacaaacctcaatgttaatagggaaaataactcactgattgttggtaattaatctgaatatcttgtatttctgtacagggaataacaatactcttttatattgaaggctaactaactctgaaattattgatatcttttttacttcctaattcctgcagattgtactttctgctctcatcatgaatgccccattagtctcatccctaacttctttgtggctttgtggtcattctaccaggctttgtggtcattctaccagatcttaaattcgtcgtgttcctgacaccctggacactccttggctctggactatgcacctcacaccataccaagttattaatgcctactcttatgtgctggaagaagccacatatacatgctgatccacatagtagaaatccctgctttctaatcacaactgggtctccagtattacaagaaaaacaacaaattacaaatagacatgaccttatccaaacattggttttgtgcctttctctactgattgtggacttctttgttttttcttgaaatagccaactgctatttggctagctctgactaatcaataaacaggatgaactttccaagcgaaaactttttaaaaaaggcattgttccttatttcaacaagattccaatatgatttgcagatgaaattaaattgtcagaaaagaactatccaaacatatgaactataaaatgtattttggaaactataatattaatctagctaccattgctccaatttaatataaataagcaatcttttgaatattacatgttttaccaatgaaacagagaagggattacttctgaaagcagaatgaatactgcaattacttttgtacccaccaaataccaatcactgaaatgtaaaacaagttaacaaactggtcttaagcaatgttggtccttatgactcagtacatttgggctgatcaccttgggaacaatgattaaaaaaaaaatcaaaattttggaatttctagtttagcattttaggtgtttagaagttgccagtccaggacgggtgcagtggctcacacctgtaatcccagcactctggcagtccgaggcgggcagatcatgaggtcaagagattgagatcatcctggccaacaggtgaaaccccgtctctactaaaaaaaatacaaaaattagctgggagtggtggcacgtgcctgtagtcccagttactcgggaggctgaggcaagagaatcgcttgaacccaggaggcggaggttgcagtgagccgagattgagccactgcacactccagcctgggtgacagagtgagactccatctcaaaaaaaaaaaaaaaaaaaaaggagttacctaacaaggaaaaagcaaaacaaatgaaaaaaatccacaactctgcttagatccatcagagaagtgaggtcgcagggcaaagggatgctccccaaactggagaggcagagaggcagatacagagaattacaacttagagcagaaaccctttgcaggaaccagttatggggtaggaaaacctgaactgcaatgatgaattattggagctcagtgtggcaactctgagagttaaaaacttcggagacctagtcatacagtggccgccacacttttgtattttaccttcaggagctctaccaagtcatcacagttaatattggagaaatccctttgtgagtctggcaggagaggagaaaaggaaccattttaaaacaaaacacagcattttttttttcttaaggcctgacctcagcagaaactatttcaccagagcctaacatgctggggttttgtcagggcctaatatatctggaggagggggaaatactaagtttcagctggctcttgccttccatgtgaaggcagggaaatatactccgcctgccacccaccacacacaccttgccactacattactaaaggcctatttgctacagttacttttacccagtaaatcatgcctgcttttcagcaaaaaaaattacaagacatactagagggcaaaaaacacagtttgaagagactgaataagcatcagaaccacaggcagaaatgccaggaacatgagagttatcagaccagaaatttaaaaaaaatggattaatatgctaggggccttagtggaaaaagcagacgacttgcaagaacaaataaacaatgtaagaagaaacatagaaattttgagcaaaaaaataaagaaatgctagagatcaaaaatgctcttaagagaaacgaagaatgcccttgaagagttcattagcagactggctgaagaaagaaactcaacttggaaatatgacaatggaaacttccaaaactgaaaagcaaagagtaaaaagactgaaaaaatccctaaacaacatcctagaagtgtgcagtaattataaaaggtgtaatgtatacataatgggaataccagaaggtgaacagaaaaagaaagagcaggaatatttgaagtaataacgactaagaatttccacagattaacaacgtacaccaaaccaggaatccagaaaactcataatgctaaacgggacaaatataaaaaaaaaaaaaaaccaaaaaaacccccgaaaaaaaacccccaaaaacaaaaaacaacatctaagcatatcatattcaaacttcagaaaaatcaaaggtaaaaaaaaatctttgaagaagctagaagggaaaaaacaccatacctataggggagtgaagataagaattacatctgacttctctgaagctattcaagctagaagacagtggagtgaaaaaacatactaacctataattctattccatgtaaaattattcttcaaaagtaaagtagaaataaagactttctgagacaaacaaaaatggagggaatttgctgtcagtagactggtcttgcaagaaatattaaaaagaagttcttcagaggaaaggaaaatgatatagccagaaactcagatctacataaagaaaggaagagcacaagagaaggaataagtgaaggtaaaacaaaaacttattttcttattcttaactgagctaacttatgtatgcttatgaataagtgaaatgaataacggcaatgatacaatggatgggagggagaaattataaatattttgttattataaggtacttatattatctgtgaagtggaaagtgttatttgaaattgggctcagattagttgtaaatggatatattgcaaactctagagcaaccactaaaacaagatagaagtgtagttgtatgctaagcagagaaaatggaatcataaaataatttaaatcataaaaggcagaaaaaatgtggaagacaaaaataggtacaaagaataagggcaaaaaatagaaaacagaaacaatatggtagatattaatccaattatatcaataatcaccttaaacgtcaatggtctaaatacaccaattaaaagaccgactgtcaaagcagatcaaaaaataagagctgactgtatgttgtctacaagaaacccatcttcaatataaggacacatagattagaaagtaaagggatggagaaagatacaccatgttaaaactagtcaaaagagatgaagtagtgatattaatttcacacatagcagagttcagagcaaggaaaactatcagggataaagggacattacgtagtgataaagacatcaataccccaagaagacataacaatttttattttgcatgcacctaacaaaaacgcattaaaatacttgaggcaaaaactgataaaactacaaggagaaatagatcaatttattatagttggagacttcaacgcctctctatcagaagtgaacagatccaccaggcagaaaaatcaggaaggacatggttgaatttaacagtaccatctatcaactggatgcaattgacatctattgactacttcatccaacaacagcatattatatattcttctcaaactcacattgaatatttgtgaagacagaccacattctggaccaatcataccattctgctctcagaccacaatggaattaaactagaaatcaaaaacagctgaaaaatccctggataattagagatttaaaaaatacatttctaaataacatacgggtcacaggagaaataaagagaaattaaaatgtattttgaactcaatgaaaatgaaaatatgacttatcagtatctgtgggatgcagtaaaagcagtgtttagaggaaaatttatagcattgaataccagtattagaaaagaggaaagacctaaaaaccaataaatgaggctttaaccttaggaaactaaaagtgaagagcaaattaaatccaaagtaagcagaagaaataataaaagtagaaatcaatgaaattgaaacaaaatcaatagagaaaataaatatcctaaaaactggttctttgaaaagatcaataaagttaataaacctctagctaggcaaactaagaaaaagaaaaagaatacaaattactaatatcagaaatggatgacaggacatcactatagagcccatggacattaaaaaatattaggaacaactcaattattacaacccacaattatgaacaacccacaaatttgataatttaaatgaaatggaccaattctttgaaagacacaatctaccaatacacaagaaaggcagttcgattaggcctatatctatcaaagaaatggagtcagtaattaaaaactttccaaaacagaaagcaccaggtccagatgagttcaatggtgaactctaccaaatatttaagaaatttaaggaaaaaactatacccattctctacaacctacaatctcttctagaagatagaaacggaaactcattctatgatgtcagcattattctaatactaaaaccagatgatgacattatacaagaaaactacagaccagtatctcccataaaaagagatgtaaaagctgggtgcggtggttcacgcctgtaatcccagtactttgggaggccgaggtgggtggatcacgaggtcaggagttcgagaccagcctgaccaacatggtgaaacccgtctctactaaaaatacaaaaattagccaggcgtggtggtgcgtgtgtgtaatcccagctgaggcaggagaagtgcttgaacctgggaggcagaggttgccgtgtgccgagattgtgccattacactccagcctgggagacagagtgagactccatctcaaaaaataaaataaaataaaataaaaaacaaagatgtaaaaaaagatgtgaaaatctcaacaaaatattaggaagtcaaatccaatcacgtgtaaaaatgattatacatgaccaaatgggatttatcccaggtatgcaaggctggtttaacattcaaaaatcaattaatgttccatcacataggctaaagaagaaaaatcacatgatcatatcaatggatgcagaaaaaatttgtcaaaatccaatacccattcataatttaaaactctcagcaatagagatgaacctctacaacttgataaagaatgtctacaaaaaactacagctaacatcatagttaatcatgaggaactagaagtcttcctgctgtgatcagaaacaaggcaaggatgtcccctctcacctctagttttcaacactgtactggaagtccaaattaacgccataagacaagtaaagaaaatacaaggtacacaaatttgtaaagaagaaataaaacaaaactctctttgtttacacatgacatgatcatctacatagaaaatctgaaggcatcaacaaaaatactcctggaactaaataagcaactatcgcaaagttgcaggataaaaagtcaatatacgaaagttaatagctttcctgtataccagcaatttacaagtgtaatttgaaattaaaaatacattaccatttatactagcaccccccaaaataaaatacataggcaaatctaacaaatatgtacaagatctatatgagaaaaactaccaaactcttataaaaaaataaaagaatcaaataaatggagaaatattccatattcatggataaaaagacacgatattgtcaagatgtcagttctttccatctataaattagaagcaatcccaacaaaaccataggaagttattctgtgaatagggacaaactaattccaaagtttatatggagaggcaaaggacccagaataaccaacacaatgctgaagaacgacgtcagagaactgatgttacttgacttccagatttactataaaaatcagcagtttccagatttgctataaatgaaagaacaaatagatcaatggaatagaatagagagctcagaaatagatcccacatagtcaaatgatcattgacaaaggagcaaagacaatataattgtgctgaatctggacttctacaagcgaaaaaaaaaaaaaaaagaccttaagaacttcagaaaaattaactcaagatggatcattggtttaaatgtaaaacaaaaactatggaagacagcataggagaaaatctagatgatcttgggtttggtgatattttagatacaaactcaaaggcataatctatgaaagaaataattgataagctagacttttttttaacattaaaaatctgcactctgaaacacaatgccaagggagtgagaagacaagccacagattggtagaatatatttccaagacacatctgataaaagaccaatattcaaagtatacaaacaattcttaaaccttaacaatgagaaaacaaataacctgactaaaataagggcaacagacctgaacagacacttcaccagaaaagatacacagatgacaaataactataaaaaatgttcaacatcatatgttattagagaattgcaaactgaatgagataccactagaatggtcaaatactacacttactacacttactagaatggtcaaaatcccaaactgacaacaccaaatgctgatgagaatgtggagcaacaggaattttattcattgctggtgggagtgcaaaatggtaccgcccctttggaagactgtctggcagtttattacaaaactaaacaaacttttactgtatgatccagaaattgcattccttgatatttactcaagagagttgaaaatgtatgtccacacaaaaagatacatatgtatgtttatagcagctgaattcataattgccaaaacatacaagccaccaaaatatcctttggtaggtaagtagataaacaggtacatacacacaatggaatattattcagcattaaaaagaaataagctatgaaaccatgaaaagacatggacaaaacgtaaataaatattactaagtgaaagttgtcaacctgaaaaggctatatactgtatgattccaacatatgacattctggaaaaggggctactatggagacagtaaaaagattaacagttgccagggtttaggaaggtgaagtgatgaatacaggtggaacccagggaatttttatggcaggatagtaaaattactctgtatgatactgtaatgatggatacatgtcattttacaattgtaactcatagaatgtactatgccaagtgtgaaccctaatgtaagctacggactctcttgggtgataatgatgtatcaatgtaggttcatcgattgtgccaaatgtgccaccctgatgtgggctgttgataggggagattgtgtttgtggagatggggtataagagaactctctgtactttctgctcaattttgctgtgaacctaaaactgctcttaaaaaaaaaagtttattaaagcacatgaggcccatctaaagtagctggccaggcttgtctatgactttaccacagttgctgcccatagcttgaaacagactcatgtcttacgatctctaaggctactcgtggaaaaggctcagttcttacagaagcagtgagaaggagaagaaaaagaggacaatagtaagaggattcaagatttcacaagtggaaactaaatattatacaacaagatttcgttaccttgatcagtatgaattgataaggaagaataatacattagaggaagaacacgttttatcaaatcaatttttttaaagcatatacaaataaagaaaatatacataagttgcccttttaagaatgaggtaggacaattaaagcaaacagcaacaaaaaagtagtacagcaaaaagtaatacttacaattattctgttattaaagaagttattcacttgacaaatcctatcattttctttctggatgccatttttaagcttttctatatcaaaacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggactcttgcttttcttccttttaatatcatttcttaatattttaaagtaaactaagaaatataattgtaagttaaaactttattctagttatttgcataatataattttggcagtatacatgatgtaacagattgtacctattagaattaaagcttgtcaaaatgacaaatttgtgactaattgctacaatacctgaagtgcatcttaatttttattttttgagatggtctcactatgttgcccaggctgatcttgaacccctggagtcaagtgatcctcctgcctgagcctcttaagtagctggaattacaggcatgccactggggctggcttcatgaagtgcttctaaatgtagcttttcagtacatatagcagaccttacatacatgttgggaattggatgccagcctcacatagatgaatgcaagtaacacattccatgtggagttgttgtaataaagcggtttctgactcccagcatagacataagttttcctgtatctattgaggtctgaagagaggctagtccattatttgccagtctttatgtctggccaggtatcactctgcaacgtatttttaatttctggtaaatgaaaatagctctaagcacatgaaaaagtacctttctacttgataaaaaggcttaaaatctaactaaatccatttaaaataaattatacctcaatatgtagatccatattctggttcaatttgagatcccttaattctctggatggtacatcacaatcttgttgaaggtgctgtattttaattagcaattccttttgcttttccacttcatcaataaaatccatttcaaatttattgatggattcatgttgttcttcttttatttttgtaacatagcttaacacatacttgcagaaaaaaattaaacaaattggtaaatgaaaattttgtcacatgtagagaaagttttcatccttgagactatgaggtaggatgacatctcttatttacctatatcctctcacaagtgaggaaaagggaaagagcttctctctatccccagtttttcctcttagtatcttaggagaataactaactcccagacctataattccttatttctgacttcttaccagatatacttcttggatgtcttacaagtacttcaaattcaacatgtttaaaacgtaacatgatccctttctctacaagtcctcctttttctattgcccagtttttggctaattacattaccaatcacccaggtttcccagttaaactcatgagactcattttcaacatcctctcctgccaacgctgattgggtaaccaaaaagatgaagttacatgcctcaagacttccttgtcggccggacatggtggctcatgcctgtaatcccagcactttgggaggctgacgtgggcagatcacaaggtcaggagttcgagaccatcctggctaacacagtgaaaccctgtctctactaaaaatacaaaaaattagctgggcgtggtggcaggcgcctgtagtcccagctacttggaggctgtggcaggagaatggcgtgaacccgggaggcggagcttgcagtgagccgagatcatcacaccactgcactccagcctgggcaacagagcaagactccgtctcaaaaaaaaaaaaaaaaaaaaaaaagacttccttgtcaagcatatttagatatttggcttcaagagacaataatttcaatgccaaatgtctcatggacttcatgaataattctagatgtctgattaccaggatttgtggaagaattaccagggcccgaagggcaatctacccaggtagggcagataccagcttacttattcctcaacttccaccattccttaacctcttataatctggtctcttccttaactacccagttgaaactgttctctgacaatgatcactaatgagttctattatcaccacattgagagaatatcttcagtccatattctgactctctgaagtatttgccactcataacttcatctttgacatactcttctccactgatttgggtagcagtacttttgctagtttctctcctgtatctttgacttttccaaccttgaacccatgtgttgctcccttttctgctactgcctcttagacatttatcttttccagagttctgtttttatcccaaggctcttagtcttcattatgctttctggatgatcttacaaatgtattatctatcacctatatgctgatcagtctcaaatgttagttcttatttttctcctgccaaacctcaaactcaaatctaaatgtctacttggtttctcttcttggatgttccatcataggtatttcagcccccaaacatctcaaattaaacaatctcctgcctcatctaccttgtttctctttcttttttatttttgaatctcagttaatggtaccactatcgacaaacctgactaagcccaaatccaagaactccatctaaacttctctcccttatgtccactatcaattatttcgacctactattttaagctgctaaatatttctttaatctcgtttgtcctctccagccctgtgaaaccctccctagtagtacagtcacatataatatctcatctggaccactgtaactgcctcttattgctttctgctactaggcttatctccctcaaactcatttcttctgtattctttagtttagtacctaagtggtaatcagatcctgttaccaccaccacttaaaacaatagtctaatgattccccatctacaaaaagaactccaagctttgttattgagtctggcttctactacagtttcatcttctgtaattttatttagtacgtcatataacttgcatacacttctatcattgcacttaatacttgtttatatgtctgtctcaccccagactatgagatctttgagatgttaactcacatctgcctcctgaacatcctgacataatgtctaggcccacaggcagagttcaggtgttgctgatatcctacatattactatgctcagacccacataatctttaatttggtagtaagaatactaaatagcaaatatgccggcacctgaagcaggacttaaatacattgatgtttataactgaaatatttaaaaggatattactaaaaaagatggtaccttcagtttcttcatgattctgtggaattccatggagcatctctggtttgcagtaaaaagtttttcaatgtgtttggtttgtaaatagggaagtgagaggtttgctttaactctcattgaaagctctttttggaattcaatttccttctccaagtcaagagacaatctattcaagcactcataatgatcatccatctctgagtatctcttcaaaagctcctaaaggaaatgagaattcactcaatttataacaattcattctaatatcacaataagtagttacaactctagaattgtaacaaaacttatgctttaacattttctgtaggagagaaataaagacctttgtgtctaaaaacaaaaggaaactcttgttgtcattttggataacagaaataatagataattattatggcaatttaaaaaatttaagcaaatataacaaagaaagccaggaccaaccattcttaacattttgatgcattttcttttagttttttgaatatccatgatatgaatcaacattgacaaagtctgatgagaaatttgagtaaattcaattaagtatgtattgtagttcatggttgagtgctggtttatgtttatagtaggcagtctgagttagcagataaaacaagtgattaagaatcaaaccacctatttgtcagcttggtacagatacttcacacaatcctactatctgcctacaatctgttttctaaccctttatcagaggtagagttcaggttccagctctgccacttcttgactggggaagtcactgagccattttcacaacaacaggaagactacaataattaccacaaagttttctggggtcaagtaaaatatatgatctatacctatatacctatgtaatctataaaacagacacagtcatttaacttgaaggagacaaaattatgtttataaacatgtttctatacccaagttttgaactaagtcagatacaagtctgacttagtttaaaattctgattctaacaatttactagctgtgtaaccttgggcaactgctaaacttcctttctgaggaaggcagtttccttgtttatgaatggagcaataaagcctatatcatgaggtaaagcacccagtatggtacctggcatacagtagacatgcaataaatctggacccatagactcaagtgacttgaggctatgcaggtgacacactggtcagagcacaggtagagaaacatgtaaaattcaagttactgtaatcatgtagtaggtaacatgtttagttcaggctgctaaacaataaaacaagggcgttctcacaagaatgagccctttatttttaataatttaagaaaagctagatgttaatcaatctggaatgttggagaggggattcctgtttttggttttaggatgaatcaactacggtatacagcagcatattgaacactgacttatgtcaggaatgtgctaaatgatgtagtcataaacaaaacaaaaatgtccttagagatcttgcattccaacaggtgtgactgtaaatcctgttggctttcccttcaatgtatattcagaatctcaacacttctcactacctctattgctccctctctgggccaggccaggatgatctctgcctgggtgattgaaatcagtctttataatggtcttcctgcttccactctattttcaatataacaattaagagtcatccctttaaaatgttaagtcagattatgtttctcttgcggtaaaaattccccaatggatctccacctcacttaataaaactcagtcttttttcatgtcccacagcttgcctcttccctgctaactctctgatctcattcattagcagcttgccctcttttcgatattccttgaaccaccacagagtcttctgcctcaggaactttgtactcgctgttccctttgcctataatggtcttttcagacatctgtatggcctgaccctttacctcgttcaggtatttgctcaagtatcacttttctggtgaggacttaaattcacaagctcccattgttgtttgtgtatgtgtgtatatatgcattatacccacacacctgtactagattacaatgtttagaaaaatactgagcactatctatttattccagaggttccttcaatcccacttcaggtttcggtaagcctttggaagacaaccaataatcatttgtagttttaacagggggtacttacttttattctagagcacttttctctcaggctttccgtaaggtgctgttgtccatcacttagtaaccttttttcaggttttacttggtggttctgtcggtcctgctttggtaaaaagaaaataaacagggcttttgtcatgactatattcacatataatgtctaatcgcacacttctaaattacatgacatttcaataatggaattaaatattatacttgtcactcaaaagcaatgttaaaatgatcagaaaatgaataatagtatcagtaagttttatagggagtgaccttaactcattggtaaaaaagtagaaaaatcatctaatttttggagacaggatttgtttttcatagctacaaattaggttttagggccaggcatggtagctcacgcctgtaatcctagcactttaggagatcgaggcaggaggatcacttgagctcaggagctcaaaaccagcctcagcaacatagtgagaccctgtctctataaaaataaataaataaataaataaacaaccaggaaaacaaataaattagattttaatttctgattcctactcttccaaatctctgcattattcacttgtagttttaacagtggcacttgcttttatcctaatgcactttattggcgccaaccaaatatactggcaaaaccacctgtactgtctatggtgtttcaaaccctagtcatatattcttcccagcaccttggaaaagttcatatcctgtgtacattttgcatttctgattaaaaagtataaagtgaaacaaaaacattttctcccacttatcttgttcactacagtacctagaagaatatttgatgaatgaattaaatctctctataaatttagttcaggcccacataaagaaatatgagaataaaaaagatttttacagattttaataaacttgtctgaactctgttactttcaaaaagaggatttaattagatattttaagatatatgattctgaatatctataaatagtcataccagaggaacttaatttttatatttatcttcccttttttccttttaacttcaccaataagagcccaactctagaactccagcatgtataggtagagaaatgggaatatttgctctcttacaaatctaatccttcaaatatttctccatttagaataatgctatctcttgattaaaaaaaactttaaaatgttatattaagggaaatagactgctttaacacagtttataaaaataaagaattaaatgttattttctgaaaatatttttgcttcttttaaaactgttttctattgtgtaaaaattagagtaaccatttcccactgtcctttactgttcataggaatttccagagaaagaaataaaaacattgtaattcttttcaaaaaagcttaattcttattaatagttactacacaaaggaagactctgaactcactctagctatcatttcccttaaggttgctatgaattggtccctttccattttgagagattcttttatcctccttagctcatctctttctttagctacaattcttatttcttcaaggctttcatgaagtttcttagtcaactggaagttatccattctcacactttgcatagataagttttgggcctcaaattgcttcttcaactgttccatttcattaatttttttatgactcatattgacatcttctttcactctaagcagttgaagttcttttttctgaagttcttggatcttgagataattgtaaaacaagttagaatgtaagcagtttcttcaaggaaggcaaatagtgtctacttgtgttctatatgcacatatctatctacatatctgtatctatatctttttaattccacaaataattttgggcacagttacttccaaaagaagaacaaaacaacacatacctttttctgtaattcatcttttgatttatctaaatccttttgaatgtctgaaatttgaattgtcttttctgaaattttttctctaagtttatcaacagtttctttgtgttcttttgatagcatacgagcagtttttagttcctgttgtatttccagatcctttatggttagaagaaatcaagaaatgtaatgatataaaggcacgttacctttacttaatgattgagtttaaacaaaatcttaaaaattatacactcacagttaaaaacaaccattatacaacctcctaaattagaagagtaaagtaaaattttctgctggtagcctcacccatagccttctcctttcataccacttggacatctttctaaatcaatatcacaaaaagaataccccattcttatgcttagttttccattatacagatagtgccttattattggtggacacttagattatttctaggttttagtcaccagacacaacgctgcagtgaacactgtatttttgcccaaatatgtgaatataatggtagggtaaagagagaacacaactcactctagctttggtttcttgcaggctttccttgagttggtctctctccagtttgagtgtctcctctactcttcttagattatctctttctttcattacagatttcatttcttcaaggttttcatgaagtttctgagccaaatttaaattctctatttctaatttactcagagttaagctttggtcttttatttgtttctttagttgctccatttcagacacttttttctgtgtctcattgacatctttttttaacgtaataagttgatgttcatttgccttaagttcttgaatcttaagataatcataaaataatatgttaggtggctttttagggacagataaataatagtttctaaattgattaagacaactgtctacccatgttactctcactgatatcctgcacaattccacacagaattttactttcttttgaggtataatatatataaagcatgctcatcttcaatgtataacttaattattcttgacacaggtgtaaatctatgaaactacaacccagattaaaacagagaatatttctagcacttcataaagtttctgtgtgctccttcctagagacagccactattctgacctttatcatcctggttcagttttgcctgcttttgaacctatatatcacaatgtatgtatccattttcctgctgatagacatttgagttttcagttttttgttattttgaataaggctgctataaacattcttgtgtctttttatagaagtatgtacgtactcttttctcttatgtacatacccaagaagtggaaatgttgggcctcaggcaggctacatccagcattagtaaatactgccaaggtgttttccagtgtggttgaaccattttatatccccaacaattttaggcacaaacaaattagatatccaatcaaacaatccccccataaaaataccttttcttgtaatttagcatttgaattttctaaatctttttgcatatttgatagtttatctgtcttctcagaaacaattcctctgagtttgtcaatagtttcctgctgctctttcagatgcatgtgagcaattcttagttcctcttgtattttcagatcctttaccattagagaaattttaaaaacagtgacatatcttaatattagtttttaaaaaataaagtgatatattttcttagtaaaaataataacactgttactctatatctttgctgttgtttttaaggtacaggctttctcttccctgtcctcctctcttcacactctacttctgctttccagaggcaaacacattacacatatattactttttttaagtgttgcatagtatttcgatatattgttcatatttactgtttccttctgaggaacatttagattgtttcagatttttaattaaaatcactacaataaataacctgtggcatatgtatacgttgtgtttgtatatacacacacactcctttaacagtatatatgtaggctaaagtccgtaaggaaaatgataattgcagacttgaacttttcaagaacagtaccaaattatctgcttaaaaggctgtatcatttcattcttgccaacagtagtacttggttcaaagaagggttcattgctgtaagaacacaatacattgaattgccagggagaggaatgagcttactttagcttctatttctctaaggccttccctaagttggtcttgctccattttaaagatttcctctactcctcttaggccatcattttccttagtaacaaatcttacatcctgaaggttttcatgaagcttctgagtcaatcttaatttctgcgtttctacactttccagagttacattccaggcctctaactgcttctttaactgacctgtttgatacatagtttccctaagatcattttttactttaagaagttgaggctgggcctggcggctcatgcctgtaatcccagcactttgggaggccgaggcgggtggatcatgaggtcaggagatcgagaccaccctggtcaacacggtgaaacctcctctctactaaaaatacaaaaattagctgggtgtgatgacatgcatctgtaatcctagttacttgggagacttgaggcaggagaatcgcttgaacccgggaggcagacattgcagtgagccgagatcatgccgttgcactccaggcgacagagcgagactctgtctcaaaaaaaaaaaaaaaaaaaaaaaagaagttgatgttctttctcctgaagttcttggatcttgagataatcatacaataagttaggattatcagtagatataaaaagatcaatgatagtttctaaattgagtaggcaagtaagtcttcacttgccttcaattttagggtaattcatatcttgtttcattacacaaaaagtttgattcaaactctcagtaactgagataacttaaaaataaaatacctgtgcttttaaggcatcatttgagtgttctaagtccttttgcatatttgatatttcatttgttttctctgaaacaatccctcttagtttatcaatagtttcttggtgctccttcagatgcatgtgaacaatttttagctcctcttgtttttctaggtcctttatcaatagaaaaataaaaataatacattgagagtagtaccatccacatgctatagaaaggtatagggcaggaggtaaaaatcttccaccctcttctgaggcctcctagttctcaccctctaagctacttttagatgtcaatacattctagatacactattcctgaacttaccctgttccctaacaggacacttcacccttcaaatcagcactatagctctaccacattttttatttgtggcatagaattccatgacgtgaatgtgctgcacttatttaaccagtcccttaccaatggatggttagaattttccctgtttttgtttgtgttatttcattattgcaacttgttgcaaagaatatcctacaaatatctttatacagttgtgcaaatgtgtggaggatagttacaactggacttgtggatcaacgaataaacctttggaaaaatttggaaggtatttccaaatataccctcaccaactttcctcaatattggaccaattttatcttattttattattttttattttattttactttttgagatggagtcttgctctgtcgcccaggctggagtgcagtggtgcgatcttggctcactgcaacctccgcctcctgggttcacgccattctcctgtctcagcctcccaagtagctgggactacaggcgcccaccaccacgcctgcctaattttttatgtttttagtagagatggcgtttcaccatgttagccaggatggtcttgatctcctgacctcgtgatctgcccgccctggcctcccaaagtgctgggattaccggctcgagccaccgcgcccggcctggaccaattttatactcccaccaaccctatggcagatttttctcttaggactcaatgtcatagttactagaggtgtagagagatggtaactcactctagttatagtttctctaaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtcatcttaagaaactgatattctttttcttgagattctttcatctgagaaaattataaagtaagttacaacataggcagaatttttttaggaaaaggaagaactgttcctaaaataaggcaatcatttttacattgtaatctaatgtatgtagtactttctttcataagggatatgagtaacaataattagatgtcattttccaatttaacaagtcccactttttcctgtaattcaccatcagaatttcctaaatcccaatgaatatttgctacttgagctgtcttctctgaaatattctgtctactaacagtttactggtactcagttgaatataagcagtttttgattcctcttttatttccggtccctttatgattagaggaaaattaataaaacttaacatgaacaccgtcattatcaccttaacactatttctgtatccaaaaaaaaaaaaaataagatgggaacttactttagctacaatttctttagtgttttctttcagttggtctctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttgaattgtttcagttcattcactttttcctgaacctcactaatttgttttatattaaattgttcctctttctcataaatctcttggatcttaaacataattataaaataagttaatagtcataaaaatatgtaaacacacacacacacatacacaacttaagaggaaaaggttgcttcccaaaacaattaagcatgccaaatagtagtcttcataattcagttagctactccaaacccacccatttcctcccactgtttcttcatccccaatttaccttgttctgtaatttatcattgattgcttctaactgcttttgaatggttgatatttcagtttccttctctgaaagattcactcttaactcattaatagtttcctcttgttctttcaggcaacaatgagcaactttaagttcctcttcagtttccaggtgctttattattagaggaaattccaataaatttatagaaacattataactattttgttgtaattaactcccctttccaaatatttagggtttataataatatttggttacaaaatattttttaaaaacatggtgaaagatgaaacctactttagctacaatttcttttatgttttctttgagctggtcactttcagattgaagaacttcttgcagcctctgtaggtcatctttctccttagctacagatttcatttcatcatgactttcttgaagtcttttggacaatccgagcatttctatttctatccttagtagtgctgaatctttgggtttgaattgctccatctcactcacgattttggtagtttcattgtctttttctttcatatttaaggactgttcttgtttgctttgagactcctggatcttaagagaatcataaaacagtacagttgatatccagagatattgtgttttaggggaaaataaatcaggatgctttctaaaacaattaaggcaggattcagtgcctcatttacagagcaatctctccattctcccactcttccattattcaggcatttaatgctttttaaaaattgaggtctcactgtgttgtcagcatcttattcgaggctggagacaaaatgatgagacttacaggatctctctctttttgagacttatacttcaaggacaaagatagatatgatgttgaatcttaccaaatagagatgctggcttctcctacggcccaagtgtcaaatataatctattgtgaatgataggaagggattcctagaggagaaagctttaactgagatctgaaggataagagcattagttaggcaaaaaggagtatggaggtactgcaggtagagagacctgagaatctgaaagccatgagctgcggaagagagttgctggagaacaaagaataggaagaagaatgaattgaaataagaccggcaagatctgcacctagggcctcataggccacataaaggatcctggtctttatttaaaaagtagcaataagatattaaaagaatgtaagaaaggataacttaggcttagtatagaaactggattagagaagtctaagaatgagtgtgggaagaccagttaggagactactgcagatagccagggaaagaaatgatgttgacttggattagggtggtggcagtgtggagagaaaagcaggatgacttttaaaatacacactcaaatcaataagatttggtgactggattacagaataagcagagaaggaggcatattagtagggatagctcccagatttctgactaaaacaatgagaaagcacagtagtgctttatgaaacattaaaggaacaggtttaaaaaagaaaataaaacaatctcatatttggtttcaccctttcttgtaatttagaattattttttctaaattattttttgaatatttaagaaaacagttcttttctctgaaacatcttctctctgtttcaataccttcttggtattcaagagcaatttttaattgttctgtttctagtcatttcatgattaagagacattaaaaaaactggtaacataattataatacaaacattataactataacacaaacacaagccttgattcttataagacacttgttaaaatgggaggaaaatacgaaacttactttagccaaagtttctctaatatgttctttcagctggtcatgtttaacttcaagggcttcttttatcgttttaaggttgtctctttccttggttagagattttatctcttcctgactttcttgaaatttttcattcaacctgagcctttccatttctattcttgccagtgttgttgagtccttggttgtggactgttctgttaataactccagttcattcattgtttcctgagtctcactgacttctttcacattaggcagtaactcttgttcctcatgaagcactgggatcttaggacattcataaaataccaaggttactatcaggagattatgatcataatttttttttttttgagacggcatctcactctgttgcccaggtgggagtgcagtggcgcaatctcagttcactgcaacttctgcctcctgggttcaagagattctcctgtctcagtctcctgagtagctgggattacaggtgtgtgctaccatgcctggctaatttttgtatttttagtagagacggggtttcaccatgttggccaggctggtctcaaactcctgacctcaggtgatctgcctgccttggcctcccaaagtgctgggattacaggtgtgagccaccgcatcccactggccattatcataaatttttaaagggaaaagatcaggatacttttcacagcaaggaaagtcatcttgaaccctcaggcctaccttggatcacaaactgctcattattcattttccctcaattcctgctaaagctattcatgacttttctgggtcacattctgtcatacttttctttctttgtagcttagacccaaagtgaaccaattatactttgctagcagtctgtttcatacttatttctccactagtttccaagctataagagaaaaaccatagctgagcaaactatatcccaataaatgtatgatctccattttcagatgggctccaatgctatgtctcaatttttctatgtgtatagattgatttctctttccatgataaattagtggtaccatgtaattttgcgtatttctgcatttaccatattggaattaagggattttctttctagtttataatggggggaaagaacaatgtcttatttatatctacagtctcaatgtctggcatggagtaggcttttaatacaggttggcccagtaatcccaatgtttcactttctccatagcatttaccactatttaatgttttcttgttcatttgattgcttatttatcagctactttctttcactacaaatggatcagagggattttaggggttttgtccaccttgttctcattgcatttctataacctaggagtgtgcctgccacattaaacactcgacaaatacttacccagtcaattaatgaaccacatcctagctacttcttactgcttatctttccttcaaaggagaaaggaaggaagaagtgacaaaggatgaaaggaataaaagacatacctcttcttgtaatttggtatgggatttttctaagtcctgagtatttattatttgagctgtcttctcagatacgcttcttcttagttcatcaatagtttcttggtgttcttttaggtgaatatgagcaatttttagttcttctttggtttgtaggcccttggcgagtgaaatttaaagaatattgtaatattcttccaacattgctcccctctttccaagtggctcagattttaaaagaaacacttaatagatgaaggaaaagggtataacttactgtagcttcaatttctcttatatatcctctaaggtggtctctctctgtttcaaatgacttctgtaattcctttagaacttttctttctttggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctgtttttcttggagttgctggctcttaaaatgcacaatttttataattaccattttacttatattctcaaaattcttacacaaaatcattaacagccttgcctcctatcagcatataaataggtaagtagcattaaaagtaaatgaaactcacaggcataaatgtctgcagtggtttgaatattgtcccacccaaaattcatgtctcccaggaacctcagaatgtgaacttatttggaaatagagtctttgcagatgtaattggattaggattgagacgtgatcctactggagtaggtcttcattccaatgagtgtatttataagagacataaaagcacatagagaggcacagagaaggaggtcatgtgaagcagttacaagccaaggaatgcgaagggtagctgggagacactggaagctaggaagaagtaaggaatgattcttccttagagccttcagagggaatatggtattgctgacacttaaatttggacttctaggactcagaactgtgacagaatatgtctctattgtaagccatcaagtttacagcaatttgctatggcagccctaggaaactgatacaggctgattaaggagataaactgattaaggagataaggggaagatgagataaagtaaaaaagcaaagagactaattaaatatacaaatacagctaccaaataactataattcctcatcctcttaaaaaacttttggagaatttattttcacttccaataagatgcttatgggtggctcccccaaatactgagacattaaccttcacaggctattgattttaccttttttataggagtatgaaatagacataaggttttagtaaactcaattaggtgagatagtgaaagggatcagaattaaaagaaaacacatattaagaaaaaaacaggctgggcatgatggctcacacctgtaatcctagcactttggaaggctgaggcaggaagactgcttgagcccaggagtttgagaccagcctgggcaacacagtgagacctcgtttctaccaaaaatacaacaattagctgggtgttgtggcacagctaatttagtctcagctactcgggaggctgaagtgggaggacagcctgaacccagggggggttgaggctacagtgagctgtgatcatgccactgcactccagcctgggtgacagagtgagaccctgtctcaaaaaaaaaaggaggaaagaaaaaagaaaaaatattccacagaataataacagaaccgtactatattatctattatgcaagtggcactgcccttagcttatatagaaagatctctatgggtgcattttagaatctcttgggaactacagctgttacaggggtcttagctcttacacaaatatcccaataacacctaacttctatataagaaatgattcaggaaactgcaaacatctaagagatggtaatagtgataaatcttacatttcaaaatgactaatgcatctctgcaaggaaagaatctttgttttgttgactaatatatctcaagtgcccaaaacagtgcgtggcccatgacagtgctcaataaatatttgatgaatgaatacatcatatgatttgtttaaatgatacaaagccctctctcacctaaagactctggaataatataatcctcataaggtatgttagtttagatctcagtgtaagttaaaattgtccaaaatactagcattgaaatatgttcatttgggaggtatgtgctatttctggatttaggtctacagaaataaaaattaccaaaaaaaaagtttagttagaaaaaatggccagggaaataactttaaaaattcaccttttcctttagtttttcttcaacttctgccagtctgtcacaggtcctagaaagctctccttctttctttatggcatggttcttttcttgtgcaactatctcttgttgctttttaagttcatccccaagaagtcttaattcttcctggttttcaatggtctagaaagaaaaaaaaagttgagattaaagtaaatattagctaacatttatgaaatcaggtaaaacatcagcatttctctcagtctgcaaatgaagaaatcagggaaaactatataggaaaagacaaatttcaaaaaagaaagtccttattttaataatataagatgccaagaatctgctttttatactgtttctttactgctcaatttacattcctaccatgagaattagaattgcatttaacattctatcatgagagcttagcttatttctacctttaagtcaaaagagactttttctgagctatcactgagtaataatgagactacagctatagttttttcaaacactgggatggctttggttttagcacagatcactgccagcgagctcaaaatggcagccaccctctgctagcatgacttgggctgatcctggttattaggctcacacagtgacattctcacgtatcaagaccacaaaaacataacaagccagagactgagaagaaaataccattgtttgtttgtgtgcttatttacattctgctcttttgatgaaggagacaatccccaaaacttataaaattaaaacaatacaaatggtcgcattctactatgatccacagtgaacttctccaaatatttatttaaacttatacacattgtatcacccctaaacatagaaaacctaagtgtgaaaatattggcagacatcaacaacaaacaattaaaaataaaatttaaaaattatgacagcaaaaaaaaagagaaacatttaggaacaaatttaataaaatattaaaagacctatacactgaaaatctacaacatacctctttgagaacagacaaattacagaagaagatatacaatggtctagaagcataagaaaaaatgttcaacatcttagtcattagggaaaggcaaattaaaacaacagtctgcacacccattagaatggctaaaattaaaagcaccaataaatatgaagtgttggtgaagaaggatgtttgagccaccagaattctcttaatttgctaatgggaatgtaaaatgatataattactttggaaatcagtctagcaaattctcatcaagttaaacatattcttccctgtgacacagcaattccatttagatatttaccttaagtaaataaagctatgtaaataaaaagagttgtacgagaatgtttacagcagttttattcaaaatagccaaatactgaacggaacccaaatttccatcaataggaaaaagaataaaaaaattatggcgtattaatacaatgaactattccttggcagtaaaagggagtgtagaaagtcaaacataagagactacatactgtatgattctatttgtataaagctctagaagagacaaatgatttaaggtgaacatatcaggactgataatctggcggggaggaggtgatgagggtctgtgatagaggtgtgaggaaactttctgggggtgatggaaacatcttctatcttgactggggtgaagaggaaatgggtagagacatttgttaaaagtcgtcagaccatacacttccaccagatacatttattgtatataaattatacctcaataaagttgataaaaatctgaaacaaatgaagacaaaaaggtaatgccaagtatacagtgctaaatcctaccatttcaatattttcctttaggtcagtcttcaattgttccttttctgctataacactctctaacatttgttggagttcatttttctcctgtattaaagaaaatatcttcctttgttgctcaattatctcattatccttaacatctgcagttagtgtttgggtatttttagcttccaaatcctgttttttatctatgccaaccatctaaaacataaacacattacagaagaatttcttaagtagttaacaacaactttaaaaaataataaaaatagccaacacatctattatgtgccaggtactattctcatatcttaacacatttaatcttgacagtaactttatgaggtaggtattaccataatcttcatttgacagatgaggaaactgaactggagagaggtaaagtcacttgcccaaggtcactcagaggtttagctaggttttgaatccaagtgatctggctccaaagtttgtgctcttacgtctgttcactaatcagaacaatatggacaactacaaatattaataattgtcttcacgtatgataggttaacatgattctgcatgtttacttatttcaatgacattaatacattaattaaaggatatctgcctttagtttgtacacatcttccataaatattttccaagtttcattctagtagtagtttgtttatttactactaaacgagtaagcaatcttgaactctatcactttatctatttcctcctaaaagctgggaatcattccctgtctcccactccctgcaaatctttattttcagaggcagtcctacttacaaaaggctggagttttattatatgtagggggataaataattttgataaagatctatttcataagggtgaaattcatcttttcttaatatatgtatattttatatactgcttaagaaaaatgttatataaattcatttattcataaataagtcacgaccaaatgtaacctaatacgtgaacttattggtaaagggagacagagactgaaattactattgctggtacaaatttagggtattattgtatgacattacactagttcagcaaacagctccatattgcctacacaggtatttaaaagtttttataataatctataatcacattagaaaacaatagaaaaataaaggataaaaatcatccactgtcaccaacttcacacaacaaactattagaattctggtaaatttacttctggagttttttccattaaaggttttttttttgtttttttgttttttaaacatagctattataatgaatttatatgtgtgattctttttagtttttatcttttccacttagatcatatgtattttcacatgttgttatgtaacctacaaataatttttagtagctgcttgattctctagagtagatataaactgtactttatttagcaacccccttattgttggcaatatgcatgagcttctagaagataacagtgatcacagagctaactacatgagaaattaaggtagggaacacgtagtcttttgggactagtctgttagatattataattcagaatctcatatctttcaaatacaaagcagattgagacaaaattttctgtaatgatagccaaggtttatttcaaatctgaactcagcctagaaggtacttcaactaccacagttatgaataaaatctaatagatctaattattaaataaaaaattattagaacctgtgaaaaaggaaaaaaattgtcctttatataagaataagcttactaatcataaaatatttttgttgagatacattaaaaatactgcatttccagaaacagacacatcaagtaggactaaaaatgagcattccaaggagattcatgatagacctgctagtgcagctctctggtgcctagatgaacaggggagcacctggaaatccccatttccactcttttattcccatggcagattccagcatgagcatgatacaagaccaaattgatctcagccttccatcccagactttaggatccctggtgaacagaatggcctcagaaaagccccagctacatccttttatcaacatggataaatgactccagcatatacttggtaacataggatcttagctgttcccagtgagtataactctactcttcccttcatcttctattgtctctataactgcattttggatttgtttaaaacagttattgattgccatatattattgtcaaaagtctactaaaaaaactttcccatcataaaagtggaagttattatttctttctttttttttagacagggtctcactctgtcgcccaagctggagtgctgcagcatgatctgggctcactgcagcctcaaccttcctgggctcaggtgatcctcctacctcagcctcctgagtggctgagactacaggtgcattgctaccatgcctggctaatttttgtatttttttgtagagacggggtttcaccatgttgcccaggccggtcttgaactcctggactcaagcaatctgcccaccttggcctctgaaagtactaggattacaggcataagccattgtgttgagggtaaatttcaaattgaggtcaaatgcctttggcctatggttattccaaattataaataagctgagaacataagatacagaaaaagtgagagagaagaactaaagcataaggagatggaaataaaaaaaaagttccattttccaaggcagtattttgccccggagtaaatgggggaaaatgcagctcattttatagaagtaatatataaatgtacagatatttatttatatcaattggatcttactgaattactttgaaatgtgtatttgcttttatttaataatgtattctgttaaaaatgcatgactgtacaaacatcagtagcatttctgtacactaacaatgaacgatccaaagaagaaattaagacaattttatgtataatagcatcaaaaaagaacaaaatactaagaataaacttaaccaaggaggtgaaagacatctgctgaaaactgtaaatgttgctgagaagaaattaaagaagacacaaatggtaagacatcccatgttcatggattagaagacaatatttttaagacatcaatactaccgaacaatctaccatttaatgtaatccctatcaaaatcccaatggtgtcttttgcagaattagaaaaatctatcctaagattaatatagaaccttaaagggccccaaatagggaaacgaatcttgaaaaagaagaacgaagttggaggtcttgtacttcctgatttcaaaacttataaagctacagtaatcaaaacaatgtggtgctagcataaagacagacatataaaccattggaacagaatagaaagaccagaaattaatgcttgtgtatatggtcacagtatcttcaacaaggatgccaagactactcaatggggacaggatgatcttttcaaaaaatggtgttgggaaaacaatagccacacacaaaagaacgaagttgtaccctgaccttacactatatatacaaataaatgcaaaatggattacaggcctaaacgtaagagtgaaaattacaaaactcttagaagaaaacataggggaacagattcatgataagggtcttggcaatgatttcttggatatgacaccaaaacacaggcaacaagagtaaaaataaataaacttgactacattgaaattaaaaacttctgtgtatcaaaggatacaatcaacagagtaaaaagacagccgatggaatgggaggaaatttttgcaatattgcatataactgataaaggggtaatattcagaagtataaagaactcctacaactcaatgacaaaaatcaaacaacccagtataaaaatgggaaaagacttaaatagacatttctgcaaggaagataaacaaatggccaaaaagcacacgaagattcaacatcactaatcattaggaaaatgcaactcaaaaccacgatgagatactgcctcacatccattaggatggctactatcaaaaaaaaaaaaaaaaaaaaacagaaaatagtgtgttggcaaaggtgcatataaaccagaacacttctgtcctgttggtgggaagtaaaatggtgcagctgttatggaaaacattatggtgctttctcaaaaaattaaaaatagaattaccatataacctagcaattccacttctggatatatatatccaaaataactgaaagcagggttttgaagagatatttgttcactcacattcataggagctttattcacaacagccaataatgggtagaagcaacgcaagtgtccatgatggatgcatagataagcaaactgtggcatatacatataatggaaatttactcataaaaaggaaggaaattctaacacatgctacaacatggatgaagacattatgcaaaatgagacaggtcagtcacaaaagataaatactgcatgattccacttatatgaggtactcagagtagtcaaattcataaagacagaaaaataaatggtggtagccagggtctgtgggaaggaaaactggggagctgttgctcaatgggtatagttttggttttgcaagatgaaaagaattctggaaattggttgtatcacaatgtgaatgaattttacactagtgaagtatatacttaaaatggttaaggtggtaaattttatgttatgtgtattttactaccaatttaaaaaatatatactactatatactattccaagctatatatttacaaaagattatttcaccagtctcctattgaatattttaaaattctagcagtaaatactctggataaaataatatgaactataataaaaatgagacatgttattacaaaattactgttaccaatatatcttagaggtgttgtgggaaagtagaaaagaatactgttaataaatgaaaccctggtataacgttataaggcaatcccctctgcaatggactgaattttaaactctaagcaagtttagtatagtaaatttgacataaaataagtatcagctatgcaaaatttggactaatacatttttgggccctttccctttctaattgattataaacatattctatcataagttatttcaaaggcattagggataagcttgtaaaattattgttagttattaccattgtgagtaacaaatgaaattgagaatattatgcatttaagtatttgaggttaaagagtatatatacaagcatatgaaaactctgaaaataaacaccctttaccttttgctgaaattcatctttagtttctcctgtattttcctccatatgcaaattcctggaaacttcctcagaaattttcgattttagtgtattaattgtttcttgatgttgtttcagagactcaagagcatttcgtaattgttcttgagtatctatattctttgttagaaaaatataaaaacaatttccattagaatatgaaacaaaattattttgtagctactacataacataatcataaataataaatgatggcctctgcaatgtttttaagagtctccaatttttcaaagtttaatcaatcaaaaccttaccatgttaacagtatcgtgaatatcacttttgagttggtccctctcaatttgcaagctttcttggagttgttttagatcatctttttcttgagttaaagtttttacttcttctaaagtttgctgcagtttctcagtaatcagtgttttctccctttctacagtttgcagcgtagaatctctattttctaattgttccttcagctgttccatctcatttagtctttcttgaacctcacgtgttttctcctgaagttcttgggtcttgtaagaaagctttaaaaaagaaaaagtaaatgtcacacagtaaaagcagagcagtctgaggcatacatatatacagaaaccaaaaccccagaagactaaggagcatttctcaaaatagcatcttgtaccaacctcggtcttcaaagcacccaaactcgaatcaaatttttgggcttctttagagagattaactatttcctgattcattctctcattctcctcaaggaccatcttatacttttgctcaaagtccatatgaagggttttgaaattttggaattcttgatcagtgcttttataattcgactgtgtagttgctaggtcatcttttgttttcccaatttcttcaagtaaaccttgaactctactctccttatgaactacttcagaaaacaatttatctttttctgatgttattatatggagctcttcagatttgtcttgtatctatggaaaagaaataaaatttagggatgttagcaacatatgattcactgaagcaatttttaggaaaaaaagctttctctgcaaaaagagaagttatttacattcagcaaaaatttgactgtggaaaggcaatatagtagtactcttattgtcacttttccctaactcagcttgtttaactctacctttgatgttttattttctaatctctttgtattctagaaagtaaggtctgcatggaaaatagtaaaggcacataatcagattgtctttatttccttacctatcattttaaagtgttttctaactttatcatgtggcaggcatttctcagaatttgacatttttttccctaaaggctttgaatgcctctcaggtttccaaaaacttaatcaatgaataatttaagtaatgtttaatcatttaaaattgttatttaagaagtatcttaagtggtatggtccatgaaaaaaataaaaatagaagtaccacttaagtaatatttaaataattacataatttaaataacccatatcttgtatattaacagtttaatcactgtgaaagataagggcagagagagatgagaaaaaaagaagagataaaggagggacaaagtaaagacgggcaatacagcgtgtagctacaatcacgggtttaggaggcagatttatgtggctcaattatgagtttgataatgggttattgggactaaaaaactacctatttttgaagagtttataagacgagtaaatgaaataatgtttttgaagttctttagcatgatgtttgccatacagtaagtactcaaatttttgccatttttcttttagacaagtagaaagaaaaactggcaggccatggatttacagaaacattcaccagcctgcaaggtttgcattaacctctaaaactttatcagtgcaacctcttttccctcattactgtcttttattcaacataatgatactactactaccaaaaaaaatggtaaagactaagggtgggccgtaatactgtataaatgcaacatttgaggactacagaaatggctgctacatggattatattactaagtattctgttaaatacaccttgaaaaaatatattttttaatctagtagcataagaacaaattagaagatgaactatattcatttctatttctaactagtcaaaacgtttacagtatctctcttgtctgctagtttaaaataaactataccaaaatatttaaggcactattatcgcaaaggtttttatttcaaaataagggataagtgcttataaatgtgtttacctctttcctcagcctttctacttcagaaggtaaagatttcaattctgaaagcaaaatgacttcttcccgcaaagcttcattttcttcaacttctttatttagttctttctgaagatcagtaatctttccttccaattccaaattacagagcaaatctagaaagttttggtaaattgtataaagatccaatgttgccaaacaggtaatttaatttttaattgtccttgaatcacctttttcaggatcaggtaaagtttatttgaaaaataatcccttatgatttgaaacccatggaaatctttataaatattaataccaaatgaaactaaaacgtaatattgagtttttaaaaagtcagagtataatgaatttttaatcattgaaatatgcttgtcaaattgtttaggtacatttctagaagaagtcagatttgaaaaaagatgtttaaaattacaaaataccttttggaactttgccatctataagggaggtgagttttgttatctcattaaaagcagattgtaattctttctccagatcaacttgcattttcttttttgcctccaactggctttgatataactgaatatcattttccatttgcttgtatgtagttgcaagttctttctattgagaaaaacattgcaaatgcacaaaaatacactgatcattacaactactttattataaatattacaaaaaatacttaccattttctccttcagctccagattttcacttctaagaaaggctgattctctcttggcatcaagggctacagtttcagcatcaaacagagtctgcttcatttgttttgggtcttcaatgctttcctagacagatgacaaaaggggttcactgaaatctaattttcacagagttggaaaattcttaagagaacatgtatataaatgttaactctagctaatcaaaaagcgtacaaatatgctagttaccaaatatataaaaagaaataatgttttcctaataaaaataatttttaaaaattctggtcatatttttcaaattatataagcaatatatcaaattatataagcaatgtatcataatttagatctgttttgtttaaaggttaaaacaactgttgttcggcaaggctgatgaagttttctatgtatttttattttgagttattctcttcagcacatgataggtaagtggctaacagttaaattaaagatattaacccacaaattgaaaaggaaaaagacaaatgatctaatagaaaaatagagaaatgatatgaacaagaaacttacagatgagaaaatgcaaatgaaaaatacatgaaaaaaatctacaacctcatttctaaagagaagtggcattttaatatgactttagcttatatgaaatcaatgatatgtccttggaaaaaaattaataaattaatacatgaatgaataaggaaaaagaaatagtaatttttaaaaagtgggcagttctgcttgccacgctatgaacagacactccagaatacataaaagtgccttcctatccagggcctcagaataggatgatatgaaatggtatgaacccctttgaaaagaatcatttgtcacaaataaaaggcaacaaaagaatagaaggtaacaaaaactaaaaaactcaactgaaaacagaagaacagaaactagtcttttaaaagttccagctagaaactgttatcataaaaaaaaaagtattaaaaactggaaccaaacatatataagtaatcaggtatactgaaagcaaactgaagcgattaaatgacatcatcatcagattcaatgttagttaatgccaagatcttatatcaactaaaatcatctagagctataaaattgtgaaaaaatatcccagtttaatatttaagatcttgactatatactactgcatgcatttgtataaaactactgaaaaaaattcggaattttaaaattttactgatttttttttttttttggagacagagtcttgctctgttgcccaggctggagtgcaatggcatgatctcggctcatggcagcctcaacctcccaggctcaagcaatcctgccacctcagttacccaagtagctggcagtacctgccaggcttatttttgtatattttgtacagaccaggtctcactatgttgcccaggctggtcttgaactcctgggctcaagtgatctcccacttcggcctcccaaagtactggcatcacagggatgagccactgtgccctggcctaaaacttactgatttttaatgggagcctgtccttaacttccttatatttactcaaaggatgacatgatcaactttccacaaatgtgactttatctctaaaatggcaaatatactaacagtccctatctcatagggttattgacagatttaatgaaatatatataaatttattacaacaatacacagcacaaagtaggtccagtataagcatttgctaagatgatggtatgctatatatatttatgtgattacacaacaaaatacgcctgatttttaccaatgagtatgacaagtccatttttatattttctagcttttgagagtctatgtattcctgtagcttcttaatctggtcttccttttctctaagcagctctacttttgaactgagttcattctaaaagaatcaaaggagagagtaacaatttagaatctgatttgaagtctaagggattaaaacagaacttatatatattagtttaaattcatagtaaaattcaaagtcactaatattttaaaaacataattcccttatttctgacatcatgttcagttacatatgttgcatgttttatagttctaattgcttatcaatagaaataccaacatgaatgctcacctcaagatcttgattatatacttctgcatgcttaactaaattctttaagttcgaaatttcatgaattagttgcatctgtaagagcatgtgaacaggtaacagagcaaaccaatagttaataaagcaaagcaaaaaaaaaaaaaaaaagaaaaagaaaaaaaagggcactggttcactgcttcagaatcacccaacagttagaaaggactgagatcaattgttcaagctatcgcaacaaagcacctcattatttaaaaatactagaaatatcacccaaaacatatcaaacaaataaaaaaaaacccctcagcatgaccccaccaagtagctatatcatctgttaataaagctacaataatgtcaatagcaaattagtatgcactacttggaggagagatttaaaaagtggtaatcaaaccttgaaaaatacacgtttagtagatttttgttttcagtcagttaagtacagaaatgtattaattcttataaagttttttcttcccataaagtatccatcagctctacattagtgtactttttaataagttctgatttggaatctaggtttggattagggttgtttcatgcagtgcctttacaatattattacttttcaccagtgctacacaggtatggaatgatcaactatgaccttgatttattccagaggaaatattgcactccattatattgttcaaccatgtaaaagtataaaggtagaagtatttctattgaggtgtcctttctaccaaaatatctgtagcattaaatatctgagtaccaaaaagtttgttgaaaacaagtaaaccacacataaccaagataaacattttcccttagaattatttaatcttcataatcagatgagcacttacagagtaaaagcaaattctaatagtatgtaaggggcttgaaaatagtatcttatttaaatattttctggatgtttaactgagtcctgactagttttaaatttcagactagtgcaagtgttgacattactattttaggtcagtgctatccaagagaaacataatgtcagacacatatgtaatttaaaatttcctagtaggcacattaaacctaaaaagaaaaaggcagaattaactttgagaacatattttattcaacctaatatatcaaaaatatttcttccaaaatgtttcttcaggtaatctatccaacatgtttctttaggtaatcaatataaaaaaaatgaacaattttacattcttttttatatactatgtcaattcagtctggtcccatttcaagtgcttaattgccacatatggttagtggctaccccactgtagaacacagtcttagacatttgtactgcttttaatttaaattggctccttctttcaccttttcttccttatttttaacttctgtgaaagaaaatcacatttaccaataagaaagaatcaaaaatcaatcttaacttttaaaaatacttagaagagatcgggtgcattcagggtagtatggccatagataatgaaaacatttaaagaatactaatttagaaaagaaaattttcctacttcttatttgaaatagcactttatcttagtactggttcttatgcatagaaaataattagcttttataaaaataaaagtgtaatctcccaatgacatgtttaagatgcagagcatgaagtgaaagtgtgtgaaaaggaaaaatgatttaaacatatgatctgatctacagttaatccattgctaccatttaaattgcagatttaaatggtaattgtcattaggtgaaatgaaatatttaacttacatctccaagtagtaaaaattataaaattaaatacaccaagttaaaataggtagacggtaaagatttttctcattcctcgagtatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcagtggctcacacctgtaatcctagcactttgggaggccgaggcgagcagatcacttgagcccaggaatgtgagactagcctggccaacatggcaagacccccgtctctataaagaaaaagttttttaattatatgtcttttagattagaaagctgagctttgtgttttaaaaaaaaaaaaaagaaaaaaaagaaaaagaaatttaaaaagaacggagtaggattcttcctcctcaactgtggttaaaatgggagaaaaactgcagtgtgatacatgtcatatattctgtggtatttttgtaatctttctctgtgttgactcaattcaataagcttcaatttttcttattaatatattaatgatgtgagaaaaatattagagaaattattaccacttatcccaaacgttagttttatgtcatgttattatcacatataaaaaacatacaaaaattagatgaaattttaaagtcagaagggaccttggtgagcatctggtctctacttcaagggtggagaaatacaggaagccctgagattcagtgacttgcccaaggccttggcaacaattcataataggattggatctgcggtaagtttataagtggcaaaactgcggcttaaatccaggcaatttcactctagagaccatgttcttaatcatgacactaggccagtcccttccataaaacctagttttattgattaaagtccaatggttttgtcatgcatgacattttgcacttcattaacatgcattttaaaacaagctaaatgaaaccctgtggagaacttatagacttttacctctttgaatatagtacctatgaaataaagcaataattttaatttgtaggtagaatggaaataatagctttggcatagaattcttttttcctttaaaaatgaaaagaggttgagaaactgaacaatgatatcgaggaaaaagggtcatggccttttgggctagccacatagaagtctgaagagtagctgcaaattaattcatcttttaactacataaaacactgggtcttatttttttttgaaggggggatgttcacgaatcactttgcaagtctgataacaactacagattcttgttccagaaaaatgaatatgcattgaaaaattctgcaaaataatttcacagcatctgtggcctctaggttaaggacactttacactaataactccctttaatcttttggacaatttctgagtccctaaagtctgatggtttctggattaagttctcttaacgtgtagcctaatattttatacttagaaaatgagtgatctgtttctataaattccattataactatttagtattagttatactaattttcacataactctcttagatggagaaggaaaaacaaaacgtacaaaattagcttctccagctattctaatgttttaattatttagaaacatactttctaaagaaaaagaaatccattaatatgtagcatccatatataaaatagtcatctagatattaaaattcatactgatctcagtaggaaactgctgtgctctaggtagcatttatatatgctcaataaaatgtaatatacaaactataaggaaacaatttcaagacaaatccatcaagaggtagatacaccaacccttcccatagatgcttttaattcctttttctcttgcataagcaccagggaaagaaacatgatttaactatttttaaaatataaatgaagaaaatatttcttaaattttctaaattgtatatacatatgaaaaatggttagatcttcaacatctcaatcttagaaaaaaaaatctttaagacaatacttctgagtgatgtcaagaagatgacagaataggaggtcacctgctcacatccccccaaaacaacaagaattctgtacctattacagacaagtctttttgtgggagcctttggattcaggtaggaggttgtaaaaccccagtagaactcaagacctggaagtgttgtttttgagagtgcataccaacacccaggtgggagtcctgccaattgtgctcccaggttcatatgcagaaatggtcccattccttgaaggacttagctacagccctgtttggcctagagtctgcaaccaaaactatctgtcaaggggtccaggagaaatcacacactctagggtctcggcagatgggctcttctgcctgtcgacattggtcttggcagtggacccaaaagttagcctataacttggctcctgccctcctcaagctgtagtcctagcttagtactgcttgcacaaggacccagaagggaacatgcccatctgagccaccaggacaggcttgccggcctctgtctcatagcagattccgacggggacatgtactggctccagccctcccctgctgcagcctccctgctctcacccacacagagaactgccaagagatgaacctgtctgagccactgggtcaggcttgcagtcctccatcccacaatagactgaaggggccctgtctcagcttcaatgcctctttgctgcagtcaggaagctatctcgactgtattgggaactgctgggtgaagcacctgccccagccaccaggacaggtttcatgcatctttcccataatagatcctaaagcagtcttgtcttgactgcagcccctctctactgcagcctggcagttatcctgcctgtgtaggacaggcctgctggcttccatcacatagcagttctggaaagaaccttgaatgtcacagctacagaatgcaagcaatcctccctgcataaggaactgctgggagtcttgactgctggtgccaccaggttaagcttaccaacattggttccatagcacattctgaattaactctgaagcttggtttcagtttctcctagcgatagtctgagaatggttttacccagccggggtcctaccgggagacaggcgtatccaagtccctgtggcaggttttgcaacccttgtccatcagcagattctcaaatggccctggatcttgatactgacccctctcatctgtggaataagaacagctctgcccacctggggacctaaagagaaaggtgtccagtagtgcctctgcaggataacatggtgacctcagtcatactatagatcttgaaaagaccttataaagatggtgaagactaaaacaaatagctacattcatcttcaatgtgcagacactgctgcatgaccacaagcatcatgatcagggaaacatgatgtcaccaaaagcacaaagtaagatactggtgactgatcctaaaagatggagatgtattatctgccaaagaattcaaaatagctattttaagcgagctcagcaaacctcaagaaaacatagagaaacaatccagaaatttatcaaggagactgaaataataaaaaaaccaaacagaaatcctagagcaagaaaatacaatgaacaaaatgaaaaatgcaacaaagaacatcaatagaagaatggatcatgcagaagaatttgtgagcttgagacaggctattttaaaatatagagtcaggaggcaaaaaaaaaaaaggatgaaaaggaatgaagtttatgggacaacatcaaaaaagcaaatatttgggtcactgcagttcaagtagagaaaaataaagggacagaaagcttatttaaagaaataatagcagaaaattcccaaacctgaagaaagcaatacatatccacatataggaaggtcaaaggttaccaatcaaattcaatctaaatgaccctgccctaagatatattatattcaaactcaaaagtcaaagacaaggagaaaatcctaaaagcagcaaagcagcaagagtaaagaggcaaataacatagaagggagttccattatggttagcagtagacttctaagcagaaatctcacaggccaggatcattaaaaagtcaggaaacagatgctggagaggatgtggagaaataggaatgcttttacactgttggtaggagtgtaaattagttcaacattgtggaagacagtgtggcaattcctcaaggatctagaactagaaataacatttgactcagcaagcccattactgagtatatacccaaaggattataaatcattctactataaagacacatgcacacgtatacttattgcagcattgtttacaacagcaaagacttggaaccaacccaaatgcccctcaatgatagactggataaaggaaatgtggcacatatacaccatggaatactacgcagccataaaaaaggatgagttcatgtcctttgcagggacatggatgaagctagaaaccatcattctcagcaaactaacacaagaacagaaaaccaaacaccacatgttctcacttataagtgggagttgaacaatgagaactcatggacacagggaggggaacatcacacactggggcctgttggggattgggggcctaggggagggatggcattaggagaaatacctaatgttaaatgacgagttaatgggtgcagcacaccaacatggcacatgtatacctatgtaacaaatctgtatgttatgcacatgtaccccagaacttaaagtataattaaacaacaacaacaacaacaaagaggaatctcacaggccaggagggagtgcaatgatatagtaaaagtactgaaggaaaacagttgtaacatcaaaagttagaaaatcaaatattcagaaagtgggaggagataaagtgtggagtttgtttgtttgtttagtaatcaatgataatctgttatcagtttaaaataacctgcataactgtaagactttttcttgtaagcctgatggtaaccacgaaggaaaaaaacctataataaatacactaaaaatagaaaggtatcaaaacatactatcagagaaaataatttatccaataaggaagacagtgagataagataaaaggacctaaaaaacaaataagaaaataattagcaaaatggaagtagtaatttcctacctatcagtagttcctacctatcaatgtaaatggactgattctccaattataagatagagtggttgaatggattaaaaaatccaaatatatgctgcctgaaagagattaacttcacctgtaaggatacaaatagatggaaaggaaggggtggaaaaagatattccatgcaaactgaaattgtaagagagcaggagaagctatacttatatcagctaaaatagactttacatcaaaaactgtgaaaagagacaaggtcattacataatgataaaggggtcaactcagcaagaggttgtaacaattgtaaatatatatgcacactgaacatggcagaatatatataaagcaaatattaatctgaaggaagagagactgcaacacaataataatagaggattttgaaactacactttcagcaatggacagattattcagacagaaaatcaacaaagaaatagcagatttaaactgcagtctagaccaaagagacctaacagatgtttacagaacattccattcaacagctgcagaaaacacattcttatcaactgcacatggaacattctctaagacagatcatattaggccacaaaaacagtcttaaaaaatttaaaatcaaaattatatcaagtatcttttctgaccacaatgacataaaactagaaattaataatagcagaaattctggaaatattacaaatacataaaaattaaacacgctcctgaacaaccactgggttaatgaattaaaagagtaattttaaaaagctaagacaaatgaaaatggaaacacaatataccaaaatgtataggatgcagcaaaagcagttctaaaagagaagtttatagtaataaacatctacatcaaaaaagaggaaagaaatcaaactacctaaactattacctcgaagaattagaaaaacaagaacaaactaaaccccaaattagcaaatggaaagaataaagatcagagcagaaataaacaaaatagggactttaaaaaaatccacaaaataaagagttttttttttttgaaagaaacaaaatcaacaaacctttagctagactaggtaaaaaagacagtcgactcaaataaataaaatcagaaataaaaaaggagacattacaattgataccacagaaatacaaagaacaattatatgccaataaattgaaaaacctagaagaaatgaattcctctaccacattacctaccaggactgaattatgaataaatagaaaacctgaacaggccagtaatgagaaaggagacttgaatcagtaataaaaagtctcctatcaaagaaaggcccaggacctgatggcatcactgctgaattctaccaacagttacagaagaactaatagcaattcttctcaaagtattccaaaaaattgaagaggaaggaatttttcctaacttattctacaaggccagcattacactgataccaaaaatagacaaaaaaggaaaactataggccaatatccctgaagaacagacagaaaaaccctgaacaaaatactataaaactgaatttaacagcacatttaaaagataattcaccatgaacaagtgggatttatcccaggaatataagaatggttcatcataaacaaatcaataaacatgacataccgcattaacaaaacaatgaaaaaaagtcatacaatcacttcaacagatgcagaaaaatcatgacagagttcaatacctcttcatgataaaaactcttaattaggtatagaagtgatatgcctcaacacaataaaggccacatacaacaaacccactgctaatgtaataccaaatggggaaaagctgaaagccttttactctaagatctagaacaggataaggatgttcccttttgccacttttattcaacatagtacaggaagttctagctagagctattaggcaaaagagaaaaataaaacataataggaaaggaggaagttaaattgtctctatttgtagatgatatgatcctatatacagaaaaccctaaggactccatccaaaactgttacaactaataaaaaactcagtaaagttgcaggatacaaaatcaacataaaaaaaagtagtatctctatatgttaatggcaaactatccaaggaggtgtcagatctctcaaatgaaaactataaaacgttaatgaaagaatttgaagaagacacaaatgggaagatatgcatgttcatggattggaagaatattgttataatgtccatattgcccaaagtgatccacagatgtaatgcgatatctatcaaaacaccaaagacattcttcacaaaagtagattaaaaacaatcctcacattcgtatggaaccccaaaagaccctgtatagccaaagcaatcttgagcaaaaagagcaaatctggaggcatcataccatctgcctccaaaatatattacaaaactatagtaaccaaaataacatgctactggcatagaaacagacaacaggccaatagaacagagaacgcggaaataaatccatgcatatacagtcaactgatttttgacaaaagtgccaagaacatatgttggggaaaggatagtctttcttcaatagtggtgctgggaaaactgaatgaatatctatatgttgaagaaaaactagatctcctgtctctcatcatatacaagaatcaattcagaatgagttaaggacttaaattctaagacttgaaactatgaaactactagaaaacaagatagtggaaatgcttcataacattggtcaggacaaggaatttttgaataagaccttaaaagcacaaccaaaaagaccaaaaacaaataaacggaattacaactaaaggcaaaggaaatcatcaataaagagacaatatttgcaaaatatttgcaatatttgcagaaatatttgcaaaatatttgcaatatttgcagaaatatttgcaaaatatacatctgacacatggttaatatccaaaatatataagaaactaaaacaactcaatagcaaaaaaacccccaaacaacccaattaaaatataggcagaagacctgaacagacgtttctcaaaagaagacatacacataatatgttcaatattactaataatcaaggaaatgcaaatcaaaaccacagtgaggtattgcctcatcccaattagaatggcttatcaagaaggcagaagagaacttgttggcaaggatgtggacaaaagagaatccttttatactgttggtaggaatatatagaaaacagtatgacggttcctcaacaaagcaaaaatagaactaccataagatccagcagtcctactactgggcatgtacccaaaggaacttaaatgagtatgttcaagaaatatctgcattcccatatttactgcagcactttccacaacagccaagatatggaaccaacctaagagtctaccaacagaagaatggataaagaaaatttggtataaagtcacaatggaatattcttcagctatttaaaaaaaaaaaaagaaatcctaccatttgcaacaatatggatgaacccaaaggacattataaaccaggaacagaaagacaaatactgcatgatctcactcacatgcagaatcttaaaaagctgatctcttagaagtacaaagtataatggtggttattggaggctggggtgtttttcagggagaagaaaatggggaaatcttggtcagatgacataatgacagttagatagcaggaataaatttcaacagctctattgtacagcaaggtgactatagttaatgacaatttattgtattcttaaaaaacataaaatttgtggatactatgtgctatcaccacaaaaacaataactatgtgaggtagtacatttgttagctagatttaaccattccacaatgtatatatacttcaaaacatcatacatcatgttgtatacaataaacacataaaatgttatctgtacatttaaaaaaaattaaaaaagcttacattatagaaaaaagagaatacttcttttaaaagtatgcttttagtttagttttacatttctgtctctcttacctcttgatcttttttagtttttctttctagagcctcaaattcatccaaatcattcttttcttttaatttcaattccatttcttctttttctgttcgtagttgttcatagtctaataccagattatcatagtcagcacgaagtgagttcaactcactttctatattctcctattataaacaagaacagattttccaatcagaaaattcaaatattttttgtttccttaataaaatttgaattatttaaataactactttaactttgatttgatatctttctaaagttctacattttggcaaactagctaacttagaatagattattttgaaagaaggagaattttaaaaatatatcaataaagtgtatgtttgcctgtgcctgacagggaattttgaccataagtcctcaagctcctcagtaataaaactgataattgaattccccaatctaactaactcttattttatgtctcagatggttctgaattcaagaatggaaacagagatattatttattgacttctaaagctaatgacaactgtgttttactataaagaggcctatttctattttctatattattataagagaagagataaaccatgagttaaaaaaatacttttttacaccagagattgtaaaaaaaacccaagaaacttctaatgtatgtattaggaacaaaaaaacactttatcaataatactttataggaattaactaacaataataagtagtaatgcaattatattctaaaattcaaatgaaaatgtctattactttatacaactatacatctttaaacacgagcaatctacaaagtaaacacggaatctaaacttactgatgtattcaccaaaattacctctccctgatatattattctatacattataaatgcctgagaattgacacttttaaaatcagtcttgttaccctaatgaagtttaccaaggcaaaacagaaactttacaaacattgtgaatactaagatctgctagtaaagagctagaggcaaaggtttacctactagcacatgtctgccttatgaaatttttagccttcctctaggtgcctgatggttatagagtagaaatgtaaagagaaaagccttcattagagccaaaatcattactgaaattaaatgagaacaagtaacaaaacctaataacaaaagaattttaaaaagagtaaaagcattatatgctgtaaaatacattaagttacctgatttagtagctttgttgctggattccattctatctcacttaatgtatcaagagtgttactgaaaacatcagactctgaacagacagctataattagagaaaaaaaaaatttgtccatgaacatgtttaccaaatttcctaagtcaaattaaagattactaaaaaaattcttatcagagatactaagaacttcaaattaactactatgtgctcagagtatgaataccaaaagtacattaatagatatggtcatttatgttattgtatgaattaagatgatcactggttggaattagtgacacaatacaggatccttaatgaaatataggttaaaaggacaaattctgaatttgagatttgatcattataagtagatttaaaattcccccccaacagactgtactattgaagaaataattttgaaacagattcctatgtcaatgccactcttttaagattagcaaaggcagatgccatataactaacaatttaattgaataataattagaaaataaaaacacctgtctcatgtgtgtttcaactagtgcatcattcttaggagattcagaataaagaacttatgattactttctatttatttatttatttatatttgtttgagacagagtttcactcttgtcacccaggctggagtgcaacgggtcttggctcactgcaagctccgcctcccaggttcaagcgattctcctgcctcagcctcccaagtagccgggattacaggcgcctgcaaccacgcacagctagtttttttgtatttttagaattacttattttaaatcatagtctccattgtaatcacatatgaaatacacagtatttaaacatgtttatcacattaactgagctataaacatagtttctctttataaggatgcttttataattaaacatagttccacttgaaaaaagcactcacattcatcaatttctcgtaataaatttatagaaagcttatgtgtttttgttgttatatttgttggtatattaaattgatctgcatagtttgagttcttcattttgttaattttgccaaggcaccaagtaactcttcgttttcttttagcctaaagaagaagaaatcaaaattatgtcatatagatctgtattcaaacataataaaacaagggaactagtttctatttttgaaaaccattgacttggtagaattcttattaagcctagtttaaaattttattagtctaaggatattgcttaaaaaaaaaatcaaactcttgactctttacttcactctaactaccattttctttttttcctactttgtcctcctcatcatttatccactccttcctcaacacttcagggacccatctcctggttcttaccttacccagctgctgtccttaccactcactctgctttgctagtttctcttcctgtgcctgcctcttaagtgtgtttctccaggtttcatagccaccattcttctcttgactctttactgggtgcaagtatcatctcatcttatttgactctctcggcaaccctagggttgtaatcacatctgaaatacacaaccctaaggttgttgagagaatcaaataagatgagatgatacttgtatcgagtatcaaccttactacatctttttaacagatgagttgggtgcccaacaagtttggagaagttgcataaggttgtatagccaattggtggctgagcccattgtctattacttcagagcctatccatgcaaccattccgtcacattgcctcttaagattacttgttgtccacagaatatactgcatactgtcatgcctctctgagtgctgtccttctgcttgaaatggccagccctttccacaccctgctctgcaaaagccccatcatattcaaatcctcgactccaataaccttcagtttaatgccagttgctaccaaagccacacctggaccttgtcattatctgaaagtcataaactagacctcttgctctcattgccgttgctgtccttccaaatcattaatttagttaatcccactatagctatttagctcatcaggggctatttagctctgttcccttgttgcatgacttttttttttttttttgccatctccctcttggttctcaccctatcatcttagattccatagatcactgtaatcatgtttgaaatttgaggtcaatgttctcaaattatttgacccactctctgtcccttacatgtaccctacacggcacactcaaatggcactgtgttcaagacctttatcagcctcctgagcactgccagagccacacagccagaagaccggctgacaagataaactggacctttaatgttgcatggcaatattcccttcccccttgtcagctttctttttcattacctacaaaggctagcctatttcaaacccttagtatctctgcaaacttatgactctaccatcacctgccatctcagcagaagaattaaacctatttcacaaagaaagtataaacctaaactcctaagagtactacctgcacagaagcctatcctttcctccatgtttgctccaattcaagaggtatttctcctatgttagtccaattctttctactatattcaagattccatccatctaggccacctcaacacactataaggtggctttcatccccatcacttaaattacttttgcaaatgagctctgtgtttctaaatgcaaataatttttgtccatctttatcttatttaacttctcagcagaatatgacactgctgaccactacctccctgaaatattctctccccttagctaccatattcactaggttttattcttaactgtacagctaaacctgggctgctttatggattcttctttctctgccttacccaattggagttttgccttctgtcactttgcctcctgttgccttctctcaacatgcaaccagaacaaactttaatttggatctgtagtagttaatgcccaaattgatatttatatctcaaatcttctacctcatattcacacatttgcattttcaacagcctgacatctcaaacaaaagaaatcccaaataaaacacccaccatttccactgctctttattcagtgtgccttaactcaaccaatattgttaccagctacccatgaagccaaggaattgcttgcaagtcattccggacacctccttctccctttctctgccctcaacatccaaacaatcacaaagtcctgctaagtttaccttccaaacatttctccaatttatccaattcactccaactccagagccacaatctttgcaggcccaagcaatctgatgtgcacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatgacagattcaaatccaggaagtctagctccagaggtcattctcttatccatgacaccctcacaccccaaaaagtctactgaataaataaattcctactcaattaaaaacaaacaaaaaatcacaccaacaaagtaagaattttgttcactatgttgtttttctttcaccagagtctacattgacacaattatgttgttttatattctacaccaattttcctgagattaatatttctgtttaagtagaaaataatatttccacatattctagaaacctatggcttccaatcacccagtttctctagaatttattaagcagaatattgcaaataaattatttaaatacattccaaacttgttgaattagaatctctacaaataggaatcagaaattggcatttttaatgaatctcttaggtactatgaaacacaaaatcttctgggtttcttgaatatactgtatcaaaggatagaaagtgcatactatataataaacatatagaaataccaattctattctctgtacatcaagtttaagctgtcatcttttaattttacctttaattcctgttgcaacgtgagggaagaagaggtcaccagcatccgtgttaagttttcaattttctcattctgtactttctgaagcaaatctttttcttccaaaagttgggccaattggtctttttccattgcctgagcccgcgtctctaaagaaacctatagaatgcaatattggattatgttaataataaatgtggctaagttttaaaaccttaaagtagcataaaagaataaaatattaaatttgtatatgaactataagaattttaatttcactgaaataaaatatactctaactgtagaacaccaaaatgcagttaccataatcaataatttctcagacttacaataaaatacacatttcttctcatgtaactattctatataccatgtataagacaccaatgctgttaatataactctattaattgcctaagaagatatgaatagtcagaagtcataaaacaaagacttgaattctgatagtaaagatagagatgttctcataagattaccatttgatattttagctcattttaaaaaagatccttaatgcgtgattttttacaaaatatgggaccatgatggttaaaacaaactaaaatgataagtaattatgctatattattagattgctatctaagggttagaagaggaattcaggataacatgaaaacacagaaggtggttctaagtaactctgtagtttctctttttaatcgaattcatatgtatttgtgaaaaattttaagaaatgtctctacttggcccatttgataatctcagattttgcccgttgaaaataaaaaacaaaatctaaaataatttcaagaaccaaatcttacaatttatagtaaattaaactaaaatttttatgagtggatttcttcttctttaaaagtgattaaaaacctaagttgtagcaactcagatattcaggaatgaagagtctctgagcatttgggcaggtctccattctaaattggttctttcaatttaatgaaataaatgattcatacatacctcctctaattgttttttaagatccattatttcttttctataccttttcaggagagcttcatcagttgatacctcattaacataaggagtattcttcatatatttagcagtactggcaaactggaaaaaaaatacgaaagtgctaagtgttcaacacttaaaaaaattcgaatttaattaataatatttagctttcttatattcaagattaaaaaaatcaatactctttctagttggcttaatacttttgaacaaagggaacattctatgtccttataacaatgctctgtaacttatcctgggtgatagtcttcgggagaataaaaaagatatattgagagaacttaaaaacatcagcttattggaatctcatttacccctcaaggtccagtgctaacgcctcctctactctgaagttttgcttctagccaaaaatatctctccttcctttaaactctatactagttattaaccacttaactactaatcaaaggcaattatgttgcaagacaagtgttatgtgccttgtcacagaattcattaattctgttaagccagggactctagtttctctttgcacctctgacagtaccttgatctggtgctcaacagctatttaaagcaatgtttctcagagtataagtaccataagtaactttaggtgggtacaccaaggtgaccattagataacattgaatccttcattgagaaagctaccctactgatatttctcatttttcctttccttttttttttttttgttttttgttttgagacatagtttcgctcttgttgcctaggctggagtgcaatggcgcgatctcggctcaccgcaacctctgcctcctgggttcaagtgattctcctgcctcagcctccccagtagctgggattacaggcatgtgctaccacatctggctaattttgtatttttagtaaagacagggtttctccatgttggtcaggctggttcctttcctttttaaaatagaaaatgtaggccttaggctcagagaaaatgaaggcaacagttaactaccaggaatttcagaattattttgttatacagacagacacacaattttttttgttaccttctatttgtggcaagtaataatagtttcccattgataggactaatattaaagtttccttttacaataaattaagtacaaaaagtgagttattttaaaaatatcaagtcaatttcagtaaaatagtgttgggtgtggcaaaaattatgaaggtaagatacaaataatcgaagtctggcaaaattaaattaagaaatgctatttagtagacaacatatcgattataacaggcgagttaattaaaaaaaactatgcttaattttagtaggtaatgttttcttcttcaagctgatcttcccctatattaagctgagataaaaatcaaactcacctggagagcagtaagtgtttcatcaaaagatactggagtaattgtgcagataatacgtgtctttgcatttcctcccaaggaattctggagaattcgtgttaacttgctatctcgataatttatgaaaccacttagcaaggaataagtttacaggagaaaaagattgagaacgtttatataataaagtagttggtttttaatgcagaactcttaaatcagccagagtttcaaaaattagtttacaagttatatgaggcagattaaaactactaaaaaatatttaaaacagaaagtaaattcagtagattataatcatatgtataagtttttgaatatatggaagaaatcagtacatttgagtgtcatcgaaatgttgcaatgttcaacctaatgaaaaatataagaatcagtaggtaagtgcacaacgggataaacttacccaacttgtccatcactaagtttcttgatcacttgtcccaaaataaataagcttcgatttatattacagccttccttgagccgcacacctgaatttattaaacaaatatgaaaactaaacttgactccttttctagatgataaacttatttatcactaagttaatgagagaaattagagggcagatgctaaagtctatgctctggtttagacatgagcccatctttaatatcagtggtagaaagagctctctccctattggtcccacttcaagtgaatcagaaaggttattacctgagaaaaatagtaaaaagaaaaaaatgaagagggagggaagaatgcagggaaaaaaaacctgtttcctgaaagagcttctctagctcttcagttcaaatcaatttttttccaacatctaaatataggcaactatgaacttacaaccaaattagcctctaatttcttatttttaaattgttaatatgctcacacggttcaaaaagtttaaaaaaaaagtacactttgaaaaagctcccttccacttttatccccattcaaccagttcctatacctctaccaggaaaccactgttattagtttttttctttagagatttttaaaaatacaagttcgtatgtatttatttccttccttcttcactgatatcaatagtaacagtccatacatactattttgcactttgctttttctcacttggcaacatatcttggaaaaatttccatatcggtaaacactgatctttttcattcttttttaaagtataaaattccattttacggctgcatcagacttcattcacccaccccatcccctgttgaaggacatgtaggttttcagtctactgcctatacaaaaaaaattgtaaaaataattttgaacagatgttatttcacaggtgcattaattagctattgctttaacattactacctaaccaaccggctaaaacaagcatttattttttgttcacaggtctgaggatggactggtttggtggatgtaggctaggctcagttgagtggctctacaataggttgcagaatgagctcaagtctgttgaacaaacttctaatcttccttggatcagcagctcttctaatggcaagagtgcaggtgcaagctaaaccatttaagcattatgaactattcatttatatcctttgcccagttttttgttggtttcttttaagcttttaaggcatctggactttgtatcagttacaaaagggttttcccactgtaagttgacttccaacaatttttagtttttttatattgaaatttttgagctacttataatgcattccttggtgtatgatatatggatccgacttaattttttttcccaaatggctatcaattaatgaataatctatcttttctttacaaatttgaaggaccatctttattgtattctaacttctgtatgtatttgggactcttgatggattttctattctatttcactgggctgacaattcacacagttttaattactatggcattataatatgttttactatcttatagtaagatagtaaaatcttaaattccactttctgctttttggaattttcctggctactcttgtctgtttttatgtttccatacaaattttaaaatcatcttacctaatttaaacatgaaaatgtactcttgatagtcttattaggattgtgttaaatctagaaattaacacagaggcctgatatccttgtgattttgaatcttttccatttaagtatgcttctccattttttcaagtatttgtttgtgtccttcaagtctgatttacaagttttcttaggccgggtgtggtggctcacacttgtaatcccagaactttgggaggccgaggtgggcgggtcacttgaggccaagagttggagaccagcctgaccaacatggcgaaactctgtctctactaaaaatacaaaaattagctgggcgtgatggtgcatgtctgtaatcccagctacttgggaggctgaggcatgagaattgcttgagcccaggaggtggaggttgcattgagctgagatcgtgccactgcactccagcctgggagacagagtgagagtctgccttagaaaaaaaaaaaaaaaaaagttttctttatatcagtcttgtacaaatctttgttgagtttcttcctagatatcacatcttttaggttattataaatggagtctttttgtctactaaatattttaacttgtttttattaatattttaacttttaaaaattaatatctgcatattaattttgtaccacattatctttcttaatttccttattttgaaagtttaaatggtttttatggaattctcatgggctttcctgctgtacaatcccatcaattgtataattttcattttttaattgatgctattgtagactaaaataaaaattaagcagatacagatgctgatttctatgttaaacttttatcagaaaatcacaattaatgattcattattattaataatgaatataattactttatcaatttctaaaaatgcctggtagtactttttaaacctgtaaaataggaagacattaagactaacatatttcatgagttttaattacctgcagcgcctgtttgagcagctctttcactgcctgcaagatcaaccaaattctgtaagatagataaaaataaatccttagggcagataatttgaaataataaaattcaaactactgaaagaacatttttaatacatggtatatctgaatattcgatctgtatccatgtctcccatgctactgtttaggcattcccttttttctctgagtcaaactgttctctatctgttcctttctttatatcttccataatgccaccagtataggttctgtttcctatacaaggtccaaaaacttactatggcaaatataattctttataagctggcacttgcactgctccaactttgtatttatccatcccttattcttacctctagctgaactactcactattccccaaacaccccatgtacttctacacctccaagcaccagctttttgctatttcctttattcagttagttctaatgttctattctgtccttattctttattcaagaaccaggcacaaagattatctcctcagcatagctttgcctactttatccttcctccccgccagatttcagatgaactgctccttgaactgcataaccagaaatctttataaacatgacttatagatacgacttacatttatagcacttattttgttgggctagtcatgcatgctagctgtactatgctgtagcaataccatgactttactgtggcatctttaagagctggacctctctttcatttcacaaatattactgaaaagaagtggctgcttattatgctccaggaagtacatcaggtgctagggctacaaataaataaggtctctgctctcatggagcttacattctacatagaggaggaggctggtaagaagagataaaaagacaaataagaaacatgttgtgataagtgtaacagagattatttaaatagagctggaaaaggggccagtagctttaggttcataggactggatagcagtggaaggcttgtcattaagctgcgatctgaatgacctgagaagaggaagctggtcccaaaaagatcaagggaaacagtagtctagacaaaaagaatagccaaaacacttagtcacaaagcagaatgtgctcagtgtgttcaaaaaaatagaaaaggcagtgtggcacagttggtgaagtgaagacaggaaaagacagaataagagaagtagacaggggccagattatgcaggactttttaagtgagatctaaaactctgaaatgtttatattcaatgagaagccattgcagggctttatgcaagggagtaatagaaccctgccttgctagattggggaagttctcctggataatatcctgcagagtgttttcctactttgttccattctccctgtcactttcaggcacaccaatcagacgtagatttggtcttttcacatagtcccatatttcttggaggtttgttcattacgttttatcaaattcaggaaatacagagaatgccacaaagatactcctcaagaagagcaactccaagacacataattgtcagattcaccaaagttgaaatgaaggaaaaaatgttaagggcagccagagagaaaggtcaggctacccacaaagggaagcccatcagactaacagctgatctctcagcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaatagccactgcaaaaacatgccaaattgtaaagaccattgaggctaggaagaaactgcatcaactaacaagcaaaataatcagctaacatcataatgacaggatcaaattcacacataacaatattaactttaaatgtaaataggctaaatgctccaatgaaaagacacagactggcaaattggatagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagagacctacaaagagacttagactcccacacaataataatgggagactttaacaccccactgtcaacgttagacagatcaacgagacagaaagttaacaaagatatccaggaattgaactcagctctgcaccaagcagacctaatagacatctatagaactctccaccccaaatcaacagaatatacattcttctcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactgcatggaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaacttatagcactaaacgcccacaagagaaagcaggaaagatctaaaattgacaccctaacatcacaattaaaagaactagaaaagcaagatcaaacacattcaaaagctagcagacggcaagcaataactaagatcagagcagaactgaaggagacagagacacaaaaaacccttcaaaaaatcaatgaatccaggagctggttttttgaaaagaccaacaaaattgatagaccgctagcaagactaataaagaagaaaagagagaagaatcaaatagacccaataaaaaatgataaaggggatatcatcaccgatcccacagaaatacaaactaccatcagagaatactataaacacctctatgcaaataaactagaaaatctagaagaaatggataaattgctggacacatacaccctcccaagactaaatcaggaagaagtgaatctctgaatagaccaaaacaggctctgaaattgaggcaataattaacagcctaccaaccaaaagaagcccaggaccagatggattcacagccgaattctaccagaggtactaggaggagctggtaccattccttctgaaactattctaatcaatacaaaacaagggaatcctccctaactcattttatgaggccagcatcatcctgaaaccaaagcctggcagagacacaacaacaaaagagaatttcagaccaatacccctgatgaacatcgatacaaaaatcctcaataaaatactggcaaacagaatccagcagcacatcaaaaagcttatccaccatgatcaagtgggcttcatctctgggatgcaaggctggtttaacatacaaaaatcaataaacgtaatccagcctataaacagaaccaaagacaaaaaccacatgattatctcaatagatgcagaaaaggcctttaacaaaattcaacaacacttcatgctaaaaactctcaataagttaggtattgatgggacgtatctcaaaataataacagctatctatgacaaacccacaggcaatatcatactgaatgggcaaaaactcgaagcattccctttaaaaactggcacaagacaaggatgccctctctcaccactcctattcaacatagtgttggaagttctggccagagcaatcaggcaggaggaggaaataaagggtattcaattaggaaaagaggaagtcaaattgtccctgtttgcagatgacatgattgtgtatctagaaaaccccatcgtctcagcccaaaatctccttaggctgataagcaacttcagcaaagtctcaggatacaaaatcaatgtgcaaaaatcacaagcattcttatacaccaataacagacaaacagagagacaaatcatgagtgaattcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcattgccatccccatcagctaccaatgacttttcttcacagaactggaaaaaactactttaaggttcatatggaaccaaaaaagagcccgcattgccaagtcaatcctaagccaaaagagcaaagctggaggcatcatgctacctgacttcaaactatactacaaggctacagtaaccaaaacagcatggtactagtaccaaaacagagatatagaccaatggaaaggaacagagccctcagaaataatgccacatatctacaactatctgatctttgacaaacctgataaaaacaagaaatggagaaaggattgcctatttaataaatggtgctgggaaaactggctagccatatgtagaaagctgaaaccagatcccttccttacaccttatacaaaaattaattcaagatggattaaagacttaaatgtgagacctaaaaccataaaaaccctagaagaaaacctaggcaataccattcaggacataggcatgggcaaggacttcatgtctaaaacaccaaaagcaatgacaacaaaagccaaaattgacaaaatgggatctaagtaaactaaagagcttctgtacagcaaaagaaactaccatcagagtgaacaggcaacctatagaaagggagaaaatttttgcaatctactcatctgacaaagggctaatatccagaatatataaagaactcaaacaaatttagaaaaaaaaaaaacaaacaaccacatcgacaagtgggcgaaggatatgaacagacacttctcaaaagaagacatttatgcagccaaaagacacacgaaaaaatgctcatcatcactggccatcagagaaatgcaaatcaaaaccacaatgagataccatctcacaccagttagaatggcaatcgttaaaaagtcagggaacaacaggtgctggagaggatgtggagaaataggaacacttttacactgttggtgggactgtaaactacttcagccattgtggaagacagtgtggtgattcctcagggatctagaactagaaataccatttgacccagccatcccattactgggtatatacccaaaggattataaaatcatgctgctataaagacacatgcacacgtatatttattgtagcactattcacaatagcaaagacttggaaccaacccaaatgtccaacaatggtagactggattaagaaaatgtggcacatatacaccatgaaattctatgcagccataaaaaatgatgagttcatgtcctttgtagggacatggatgaagctggaaaccatcattctcagcaaactatcgcaaggacaaaaaaccaaacaccgcatgttctcactcataggttggaactgaacaatgagaacacgtggacacaggaaggggaacatcacacaccggggcctgttgtggggtggggggagggggggatagcattaggagatatacctaatgtaaatgacgagttaatgggtgcagtataccaacatggcacatgtatacatatgtaacaaacgtgcatgttgtgcacatgtaccctaaaacttaaagtataataaaaaaataaataaaaataaaaaaacgtaaaactggaaaaaaaaagagaaccttgcataaagctcagcaatgactctcacaatggatccactatgactactgggtggaggatggattgggaaggggcaagagcagctgcaggcagccccatcaggcagctggggcaggaatctcggtgagagataataccagcttgggttagggaggtggcagaggagactgcttgtaagagaagcagtgaaggggtgtcttgtttattgtttttttaatctcagagcccaacaccatgctcagaagacaataacaacttagtaaatattgtgagtgatttgaaagaaagtcaaagctttacgttatttctctctgtggagatttttgagactaggcaggtaaatatgtattaccagttaaggaggctaatttttcttgcacagtgtccactacagatgacacagatacataataaaagggcaaagtggtaatgaaggcagcatgagtgaaggttaaagatgagaacaagcattcatattcaaagatactcagaggcccaatctatgagggaggagttcatgtagagcagaaggaaataaagttagattggttaagagtggccaaatcttgccccaggaagtgatatacaaaagcaatggttagtatattcgaaatccttatgatgacttcaagaaacaaagacaagggtcatggagacaaggttccaggagactgacatagtaattcaagagagatgagaaagtaaatgagtgtagcacccatggaaatgtttaaaggtaggatcagtaagaaatgggacaagtggacaaagagaaaggcagaaaaagatgagtcaaaattgacttaggtttccagcttaggcagctaggataatgctggttttactggaaataaggaatattcactatggtaggaagaaaatagtttcgttttagacatattaaagtttgagataatgatgggacacaattataaccatctttaggaagacatgaattagaattcagagactataggtaaaatatttggcagtcatcaacatggaaatgatgacagaacatttgagagcaagaacttgagtaagaaacgtcacagaatacctccaagtttttttttttttaattatttttttaggagggtagggaaaaagaagccagggtagaaaacagaggagtacagctaagagaaactggatattatcatcccaccaaggccaggagataatcagaaaagagccacctctaaagagacagagatgactctttagagacttctttccaagaagattcttagagtaagtgggtaggctggagggttggaacagatggaacacaaatgacagagcatcacgtaacatgaggaaaatcatcaagtagatcactgaatatgccaagagtattaaagctaaattattaaaagttaaaattatatgaaatatcacagtcttggatgagaaaactaaagaggttagggtttggttttttattgttaaattaaaacaagattaaagtctactaaaataagttatacaattttatagcaaaatagctaaggtgaaattaggattgaatattaagtaattaataatctaattttataaaatctgaaaatgaataaacatattatagattgcttttttccctgaagttttctaatcaaataatcttaaatcatatcccacatcaagctaaagaatttaggccctaaaaatgcagaataaagcaatatggtaaaagatagaaaaggagcaagaaagaaacagcaataatttagtgtggaaagaaggaagtgaaggtttactaatgtggaatataggaatgtttgcataatgcatatattcgcttattcagcaaatctatattagacataaaataggtataatgtgttggggctaccaggatgaatgcagtatcactcctcaatggatttacagtctaaagtactacgtttacaatacaaaatatattttattgttgtacttaagtaaaacctaaagtaatgtgattactttttaaccatccaacctagatttttgttgatcacataagtctaaattacattggctgagattttacaaaaagaccctcaaattctaagatgatctaaagtgttaaatgtgtatagaaaaaaattctactgcattagtggttagaaaaaacatcaattcctataaccctatagccctgacatttaaattttaggagatggcaaccatgacataacaggaagaaagatcctctgaatttttcctacgacattttagctaggaatttgatgatactgacaagactaagcagacaatttgtagatttcctcccacatttagtttagttaacagttcttattaaaccaaacatccagcaactaaattaaattttgttttggcccatacagtacattattatggttcattaatactcaccaaatgggataccttaacagatccttcacaattagaaggttcacccttctctctgctttccaaaatctagatagaaaaggcaagctgtagaaaaattagtgcattcttacttggaaagatctaacagatagatagaattacctaccatcctaaagatggtatgagaacgactgcttctttgattcatttttgtttctccataatgcctgctctctgtaaaaatgagttatatttcagctgcatatataataaaatccatagaaacacaataatttttattttaacttaaaaaagtatgatttgaggtccaaacgtgcttgattgaaaagatagtttttacaagtgttctaaagaaatacagcataaagtcttactttctccctttgtaatccatttcaaagccatttctgatgtatatacaacttcttctgtgagatcagcaacatacacattcctctgaaacaagtttaattatggaaagattagagaaatagaagtcacaagtttgcttttcaaaagaaggtgcaaactattatagaattcatttgtgaaagttaaaagtggcaaatggaaccataattctgtaggaatgtaacaaataattctatgaatacccacaatttatttcacataccaaagcacaacaaattctaacctgatacttccaacttgctatttttacacttaaaccaaaatattagagctgtcagtattttaaaactattcatattgtttaaaagatgaatataaatacttcaaaaaaaccctcacatactatagaaataggagacactttaaaaactatagaaattaaaggtaaacattcaagaacaataatctcaataagtcagtcaattttaaagctcccttaagtctgctactcacattgacatcttctcgaataattaaaggtttcattttttgagtgccacagagtaaatctgtaatggtttcattgtatatttccatgtaagatacacgtaagagaaattccctatcaggaaactagaagaaaaaaaattatataaaaacaccaggaagcatccaattgtgaaaacctaatgctaaatgctcatgtgcttaaagaggtaaaatgtatgtaaaacaaactaagaaaccccttggttctactgttgacaaaataatgaacacaaaaatataaaagcatcgttacagaaataatgaaaagtgaagtaccataaagctgggagaacaccaactctaggctcaaactctaggctcaaaataaaaccctctcaaaagatgttcttattttaataaaaatgctaatttgaaaccaactaactcggttgcctattctggctttctgcttcccttctttttttacctacatccactttctactgttcctttataatcactgatagttaaatggttaggtggagctaaccattctgataacattttcttgttccttaatgcctactttttgttgagagtattattgttgcagaattcaagagaaagaataaaagaactttaagctttataaagtaagttgtggagataaaagtgaatctatgctatgcctttcttctttccccatggataatcaaacaataactgtaaatctacttcctttcatctttacaagagaaatacactaagactggtacccagtttttactagttttacctgtacgtactagaaatccagttaagttacttaccttcttaattttttggaaaatgtcatgaattgccctgggtataactcccaaatgatcttctgaacccatcatggtatatgtttttcctgaagcagtctgtccataggcaaatatagtacctgcaaaaaacaaaacacacatacgcaaagattaaaaacaaacctataatgggtaaaactatgcatgcttgttgcacagacgcccaagactaaaatgtttctgcagcattgagtgaatacaaaccattgtagccttgtatggcagaatcgatgattggtgctgctatttcttcatacacatttttggtagtttcattaccatgaaagacacgatctaaacaacaacaacaacaacaacaacacagaagttaaatcaaatgagtccactgtgttttcattccaaattagtaattattcccaaaagtaaaactgtcagaatgtaggatgatcaactatttaagacacagtatttttttcaactttttggttctctgaaaatacccttccctaaggtaaaatgagttcattttcacacacaaaaaatacactacaagtcaacttttctatgttctttcaagaggcaataaggtatagtgtttgcacatgggggtctggaatctacctagatgcaaattagataactgtgattataactgttttaaatgccaattggttaccttacttaaatacatgatggataaacaattttgtttccagtgaagcagtttatagaaggcttagtctaatctttagtgacaaatctaatattattgataagccttttgtacttttaatagcaaaaggataacaaggtaacttttgatgctattataagcttaccaaaattgaaggatttacttccatcaacttgataaatgacattattgtcagttttccagtaaacttgggcagtttctccaagtgattcttctctaaaagaataaaaacaccgcattttaaccagtcataaaagtcatgtcataggaggaataattgaaaagatttcacctgctaaagaatattttgaaagatagtaacataagagaatgacagaaagtccatctttgaggattcaactcttaaatggagcttcagtgaccttctgccgcctcaaaagtgttttcttgtgaaggctttcattctcaccctctcccccagtactggtaaacaaagggatggattcaaaatgcaactctgattatgtctgtcttgcttaaaattcttaaaaccttttggaaacttatgaaatcctcagcagggcacgagtcctagatcatgtcatttctctcttccattttcctctgaattcctagatacatcctaagctctacctgaaggtcttccccaaatgacagatgtaacctctctgtgcctggaatactctgacttccctttccattaagtaacatagggattatttcactcatgaaaagcgtcaagacttttctgacaccagttcaccccacgggaagctttcgtctctgatgggctaataactcctctagcaaacattctctacctgcccatcataacacttgtcaaaaggtatcctaatggtttctttatgtagccgtttaaggcattagataatgagctcctcaaaaataggaaattcctgatcttggtatttgcatttattaaaccccgtgttcaataaaaatttctcacacacacaaagtgttagcatttcgggtcgagggccagaagctagtgaagcaaaccgatttcatttattcctcttcctgctttttctccctagcacttattacctacatatcaccacttaacatcctacattttcaactttactttctgtctcgtcccattagaatggaagagccactgggcaatgacgggagtgtctgtgttgtacaaagtcactaaaaaaaaattgataaatatttgtagaatgatcttgagtgacgattgaatgtaatgtgacaagacagactagcccttgtcttcagagggtctggagacagcagttaggtgtaaaatgactaactgtgatgagggccaggaaggcacggtcccatacgacttctctaggcggggaatggggcagggaggagcagatgccgcaaggcagagcagcacagaagggaaggtctgtatgtcagcgagactgagttaaatttaagtgaatctcgcagctggaaagtatcttctagatctccgatcctcccctgtcactttacagaccctgaaacgatggccagcagccgagtcactagacagcagagccgggaagcagcggctcctggaaacatcgtaggcctcgcccctccggctcagggcggcgccgcaggcccagcgggcaccgggccgtggtgtggcccccctacctgctgttcagcggccgcactcgcacgcagacggccacggctccttcctccgccatcctatcaggctgaactggtcccaggaaaatggccaggaccctccgcggccggcacttcagggctcacaggccgccccgcctttaaattta

SEQ ID NO: 493 - DNA, 51520 bp, Homo sapiens
attagacagaaatagaattttattttcttttaagcactgtattttttatttcttcattatagcacattaccctaatgtaatattcataagactggcatagatttgaaacttacctatctcccacctagaaatgggaagagcctaaagatatgggtcataagaaacaaaaaaagggctggattagggcactccttaggggaaggtagactcacatgggccactgaaataaaggaacctgggtggtcagctagggggcaggataaagttttttgacatctggagggggcaagaggatgaaccaatgaagatacttcatgtactttaaaattttggtgggaccaatcagttacagtaattcaaagaaaggtagtaagggaaggagaaatggagaagaggcagattatcagggtaaatgatggtaaaaattaatgagagactgcattatgatgtttaacaacaaaaacagatccaaaaaagagagccaaaaccaattcaaggcatcagagcctgggcaaatatgaatcaggaaactgtgaaagttaaaagttagggcaatcctagctgaagaggatactgaagctggtctttcccacattaactgtaaactgtggtagtacattaaagtagatatgtccttatgcaaattaagatggatgatgaaggggtgtttgaaaaaaaaggcagagagattaaggttggtgatatagatcattaccacccacatggaaagagcaagggctaaaaatgctgtttaaagaaacagctacacttttggttctattacattttaagcttaaacattacatatttcaatatgcatcttgaaaaaagtagcagctttctaaacattatgttcagcactctctcttttcacctctaaacttgcacagaagtctctccttgaacttcttcatctttattttgatgttcaactttctgcagaagcctggggcccagtaaaccaataagcagacttccaattggggctgtgatgaggatggacaaaaatgccactgtcaacacatccattccatagtcttctaattgtttctctccatgtgaccttgctgtgtccaaagccacagatcctattgcagcctataaaagtttaagggtaaaaatggaatcatgataagataagcacatataaaaaaagtgagttttttattgtttgcaaaagcaaattgcttgttcttttgctcaactaagaaagttgtaagcatcaggagatatacctaatgctaaatgacgagttaatgggtgcagcacaccaacatggcacatgtatacatatataacaaacctgcacgttgtgcacatgtaccctaaaacttaaagtataataataataaaataaaaaaaaagaaagttgttttagtattctttcaaagtgtattgcaggttttgttttgttttgtttttttacttttttagagacagggtctcgctgtgttgcccagactggtcttgaactcctggcctcaagtgatcctccctccttagcctcccaagtgctgggattacaggtgtaagtcactgtgcccagcccagctggttctgatgatctaaaaactctgcccttgcatgggaacatactgatgactcatttgtacttatctgtgtaaggtagggttacataaatatcagtaaaatacatttcaaaacacaaagcaaatccagaatcacaatattaattaaatataacataaagttctatgtactaaatttttcctgaataaagatggaaattactggtcatctccttttatctttaggaatgtggaactaaaaaataagatgaaaaacatgcagtgatacctactgaaaactgttaaattttaaataaatatatattactttagagcttaaactcattgtcaaacgtcatgaaacatgaaaatagtggacaccttgacaacttgaagttgatcttattaggtatttggtcaactccttgccacagaatttggtgaaatgttttatttggaatgcatctgttggaaaacattatgaaaattctcagtttcttttagaggcaaaatgcaatattatcagtgcagatgggaaaaatgtattaattaatctggttatcccttattccacagagaacaatgtaagcctctaagacaatgaaaaagaaaaatgtgcatcagaaacaatggcagaaactactagttgctcacaaaaacatgaatgacccctttcccttctataatagaactcctggagtttggctggtcacattgctgtccagagacctttttatagaactcttagccattatgttttagacatttttgaaagtctgataggggtgaggggaattctggagtaatgcccaaatgcaaagagcataattgaaatctggaatataactgctgagcatacacatcccccaaagcctcctaaatgaaaaacacttgattttaattccttaataacagaaattggaatatttaattataaaataatctggggcaaaacagttaaatgttgtttgatgtaattagtctgaaaatatacaaccaaagatacatcacatttgcaacaaatcataatctatacagttctaacttaattagcaatcatagatattctaacaaatgcatggtcaacaaattcaagcacctatctataatagctttatttatcacgtttattagaatgcacaaattttcggttaagtgattgagacatttgccaggaagttcagtgagttttgaataattaataccaactaataatctaggaaatcaataaagtgctttctgagttgtttttcaataaatcttttctccattacatacaaagactctggtcaagctcaactgatcatcaatcatattaacattaaaatatctccaaacattaagggaaccatgttatttctattttactctcttcttggaagctattaacatgaaaagagttaagaactctttccttgggtgacttacagagtgccgactgatgaaaactcttctctcctgttactactgctttctagtagaatagggatttactggatttttacttataccctggtgatctaaggaaatttaatgagctatcacatttaaggaatgaatataccaaaaatacaggttttaaagaatagattaggataaactcttttcataaatccacttcaattatttattttcactaaatttaaacaagccctcttattcaatatttcaaggtgtcatgcagaaatagcagttaaaatgctaagccatcctatccatcatacctgaactgtggcctttggaagccatgcaaaagaaataaatatcttttcttttaagttaaaaccagcaaaacacaccatcagaaatgtagtcaaaattcgtatcaatactgcaatgcctacggtggcaacacaaaggcctgtaagaaatattcaatttttagaaataataaaatactaggagagaaactgcatctcatggttactaattcaaaataaccatcaacagaaataatttttaaagcattaaaaattacaaatacaaaaatgtttaggaagaatatataaaaacaatcaatattaaggatcaatcaggctatttgtttaaaataaggtgtttctgtagattaaaaccagaaattaagcatatttgaattcttatgtagagatttgaatgttatatatgtcttatgctttatagcaagaaccatgcttgttcatgtgtgtaagaagaatttattaaatgatatgattaaatgataagtaataagctttaaactaagtactgtgtacacataaatgtacaatgtatagactttgcctcaaagtcagagaaagacacataaacaaccaattcatagactatacagtaagtgaggtataaacaaactaagggcataaaagagggaaaaacaatattttaacccaaaaagtcaataattctttacagggtataagaccagaagtgatagctaaaatatttatgagccagtatggagggaattagccaatcagagctggctgggcactgaccaatcagaatagacactggcagtctaccactgtttcaccatactgatgtgtactggtcgtactggtcccaattatccctggttaacatacacagctactccatttagtcctgtagaattctttgctgataaagacaagttcatcatcatttgccaaacaagggattgtgagtagtgctgctacatgctactggacctaagaatgatacagctaaggtgactcctgagtattagggtgattttttaaaaagtaacatttgttgagtgtttactctgtgccaaatgctgtactaagctttaaatgtattattttacttagtccttacaacccgtggagtaagtattattttatagttgaaaaaaccagaagctcagaaaggataagtagttttctcaaattcaaagggcgggtaaaacatcagacagacatagcgggaggatctattgtaaatctgccatatggcttttttatgggaaagttttgtggttctttgttgaaaggtatttcttcaaggttggaaagtattcaaaaatatctgtagcctgaagtacaagataaagagttgatatcattcccagaaggaaacattgaaagtttgagaagaggatgagaaggaagttttagttgagtttgaacgttaacaggacatacaagtggtgctgtccaatcaacaattggatatattgatttagagataaatagtttggaattatacagtttatagttgatgtcactagtatagataaggttagagaagttatatagagccagaggcacaaagttagaaagcaatttgataaagggcagcatttaagctacatatggtgtaaggaaaggctcaaacagcactgggaaataggaagtttaagaacttaatataaaggagtgttagagggtcaaaagcagcaaatgctgctgacagatcaagtaaagcaaagactggatttagcaatattaccttggtgagaggctggcaggttgtgtgagaggttggcaggttgtgtgataggcagaagctgggctaaaatgtatagaaggaggaaatgggaactgaagtggaaaggggaatgtagtgacctcttttgaaaagtccgaaaagaagacaagagaggtagcatggtagagacggggggaagtgaaatagaggaattttatatatatataattttaacatattattttaatatacattattttaattgtagtaaaatacacataacatttaccatcttaaccatttttatgtgtatagttagtatcattaagtatattcacactattatgcaaccaatctccagaattttttcatctcacagaatttaaactctatacccattaaacaacaatttccctttactcccagcccctggcaagtaccatttatgagtctgactactctggatacctcatgtaagtggaatcatacagggttagtctttttctgactggcttatttcgcttagcataatgttctcaaggttcatccatgttgcagcatgtgtcagaagagaagcatttttttttaagataagagagattggagactaaattctgaagagaagaaaattgcgacatggatatttaagatgtatgagaaaaggaaagaatccatatgcaagattcagaaggagtagcgggagatgggattcctagtatggatggaagaatactgtgatggaaggaaagaaggaaataatgagtacatatatacaaattaatttttaagtgcagtgttttgaatcaacagagttttaatatgatggcttttgaatgtaggaataaataaaataattaatgaacaacaaggcatttctatcccatgggtacaaactatagaactaactagttgtctttaaaattctcgctcttgttcaggacaaggctagatgaatattcttacccttggaaaaagaattgttaaggcctgaattttctgggtagtggtcagcagtgtcactttcatatacaaggaacaatattaaatgtgtaaaatataccatcttagatgaacaagcattattttctaaccaactactctaaaaaacttacatcataattaactttttatataattgtgacaatagtaaccactgtacacatacctgctggagatatttcaatgaatataaaaagtagactttattggtgagtaggctgaccaaaaaaagtgaattttaacaaaagcacattttgaaattcttacctacagtttctggtctgagagatgcaatagatacctctgctccaattagtccaaaaagaaggggctgaaaaatgtcccaggcaactgcaattatcttttcaacctctgcctaaaataacaataaaacacacacagatttttattatgtgaagttacaaatgcaaagaattttattaatttgaggtttgaattatttggcctgagataagctttatttctgtgccatctataactaaaaggttagctagaacagagcaaaaaaactgcatgaagatctttctatcacagttaagatacatgaggtgttttagcatactaaatattagtttgcacatggatattaataaaaagattcttataaagtaatcttatgaggactcctacttctgaatacatcgtgtgtatgtgcatgtgtgtatacatattgtaatatatagtagtgttttgtagtttaaaattttatgtcgactttccttcaacaatatgatttagagagcttgcaatattggtacatatatctagatatgcccctattactgctgcatagtgatctacagtatagaagtaccatagtttattcaatcatttctttattgacagatctttaaattgtttccaattttatctgtacaaaaaatactgtttaaggttatctcaaatcacgcacaaaaataaaatccaggtttactaaagtgattatcagtgccaattatcactttattgcccattatctccagctcctctttcactgttgctccacagaaaatggagctgggcctttaaaatatttttcctttgccaggtagcaccatgttaaactttgtcagtagagtgtgctaaagagatattgcaagctgaaggtgcttttcttcctggtttctgtggctcttcctagcaagatcttatagcatgcactggtggccttagctctaggttcctgcatcccaggtggcttctccagtatcagggtcctacaattcatgcaaccagcagcacctagtggccattacattccctagcatacccctggggcagtttcgtagcagattctcttgagcaagatacttccccatgcacccaaggggatggatctcctgcaaattgggagggtagattttcagcaaattctgcaagcacagcaccacagcgacttctctaggctctaacagagtctggatctcagccctgcaggcaggaatgtggagggtacaggcttaaggggatgatctattatagccataggtgctattctcatattctttaaggatgtcttcacatcttactagccaataccttgttactggaatccctggtgtggttaataatcaacttttcctattccagttactatttgatttctctttcctcataggaccctaattgatacaagaactaactttgtaacacataatgcaaaagactctaggaaaacagtgacacaattgactagagtaacatcaaaatgttttgtggcaaaagaagccataaaccaaaaaagtgacaaactagaagaaaatatctgtaccatgtgtaacagaataagaaacattggccaatcaataaaaaaaagacatagatcctaacagaaaaatgggcaatgaacccagagacagcatcatcatactgaataggcaaaagctggaagcattccttttgagaaccagaataagacaaggatgcccactttcaccactcctatttaaccggagtactggaagtcctagcaagagcaatcaggcaagagaaagaaagaaaaggcatccaattaggaagagaggaagtcaaactatttctcttcgcagattatactatacctggaaatactataccaagaatagtacagagatactatacctagaaaacttcatagtctctgctcagaggcttctagatcttataaacaacttcagcaaagttttaggataaaaaatcaatgcacaaaaatcattatttctatacacaaataacgtacaagctgagagccaaatcaagaacgtgatctcattcacaatcgccaaaagaagaacaaaatatctaggaatacagctaaccagggaggtaaaaaatctctacaatgagaattacaaaacactgctgaaagaaatcagagatgacccaaatggaaaaacataccatgctcatggataggaagaatcaatattgttaaaatggccatattgtccaaggctatttatagattcaatgatattcctatcaaactaccaatgacatttttcacagaattagaaaaaacattataaaattcatttggagccaaaaaagagcccgaatagccaaaagcaatcctaagcaaaaggagcaaatccagggatatcacactacccgacttcaaactataccacaaggctacagtaactaaaacagatggtactagtacaaaaacagacacatagacaaatagaacaggttagataatccagaaacaaaactgcacacctacaaccatgtgatcttcgataaagctgacaaaaacaagcaactggtaaaggaccccctattcaataaactgtgctgggataactggctaaccatatgcagaagattgacgctggaccccttccttacaacgtatacaaaaataaatttaagatgaatgaaagacttaaatgtaaaaccgaaaactacaaagcccctagaagatctaggaaataccaatctggacattggcccaggcaaagacttcaagatgaagactccaaaagcaattgtgacaaaacaaaaaattgacaaatgggaccttcttaaactaaagagctctgcacagcagaagatactatcaatggagtaaacagacaacctttagaacaggagaaaatatctgcaaaccatgcatctgacaaaggtctaatgtccagaatctttaagaaactcaaacaaatcaacaagcaagaaacaaacaactccattaaaaaatgggcaaagcacatgaacggacacttctcaaaaggacacatacatgtagccaacaagcatataaaaatgttcaacatcactaatcaatggggaaatgcaaatcaaaaccaaaatgagacaccatctcacatcagtcaggatggctattattattttttttaatatttaaaattaaccacaatatttgagcttgtggaagtaaactgggtgaccaaatgtcaaaggaaacataattgtacatcttttgatactttttaattttttgaatatttgagcttgtggaagtaaactgcgtgaccaaatgtcaaatgaaacataattgtacatcttttgatactttttaattttttgaaaaaatttattttaaattcaggggcacatgtgcaggtttgttacataggtaaacttgtgttatggcagtttgttgtacagattatttcatcactctggtattaagcccagtacccattagttatatttttcctggtcctctccctcctcccaccctccaccctacaataggccccagtgtgtgttgttctcctctatgtgtccatgtgttctcatcatttagctcccacttataagtgaaaacgtggtatttggttttctgtttctgtgttagtttgctaaggataatggccacccactccatctatgtccctgaaaaggacatgatcttcttttttatggctgcatagtattcgatggggtatatatacaccacattttctttattcaatgtatcattaatgggcatttatgttgatttcatgtctttactattgtgaatagtgttgcaatgaacatactcatgaatgtgtctttataacagaatgatttatattcctttgggtatatacccagtaataggattgctgagtcaaatgcatttctgtctttaggtgtttgagtaatcaccacactgtcttccacaatggttgaattaatttacacttccaccaacagaatggctattattaagtcaaaaaataacagatgatggtgaggttgtggagaaaagggaatgctgatacactgctggtgggaatgtaagttagttcagccactgtggaaagcagtctggagatttctcaaataaatagaactaccatttgacacagccattccattactggttatatacccaaaggaatagaaatcaccctaccattaagacacatgaacgtgtacgttcattaaagtgttattcacaatagcaaagacacggaatcaacctacatgcccatcaacggtagactagataaagaaaatgtggtacatatacaccatagaatactatgcagatatgaaaaatgaaaaaagctggaggcatctcactacttgaattcaaactatactacaaggctacagtaactaaaacagcaatggtactggtactaagacagacacatgaaccaaaacaacaggctagagaacacagaaataaagctgcacccctacaatcatctgatatgtcacaaagccaacaagaacaagcaatgtggcaaggactcatatataccatgtacatatataccatggaataccatgcagtcataaaaaataatgaaatcatgtcctttgcagtgacatcgatggagctggaggccataatcctaagctaattaatgcaggaacagaaaaccaaataccacagttatcacttacaagtgggagctaaacagtgagtccacagggacacaaagaagggcatgataaacactgcggcctattttaaagtggagggtggcaggagggggaggattgaaaatagtatgctgattacctgggtgacaaaattgtctgtactccaagcccttgcaacacatcatttatccatgtaacaaacctgcacatgtaccccttgaacctaaaataaaagctgaaaagaaaaaaaaaagaaacatgggcaaaacatatgcacaactaattcacagaagaagagatacaaatagtcacaaaatctaagacactaaaacggagtaattatgaaacacaaattaaattgacatgccttttttttttttcaagggggaacaccacattggaaaaatactaaaaggttttaataatgaaaagtattcatgactttgtaaggaaactcaccatttggcaggacaacaaattgataatgcttttttggagggcaattgagcagtacctattatactgtctaagaatttacatagaacagattttctcataactgaaaagaagctatatttttggatgacatttcaatgcttacaattacacaatttaaggatctgcaatatatacaccaggtcctcaaataatgtcgtttctttcaatgttgtttccttccaacaatgaaaaaaaaatcaattcttcatgttctccccatatctgcaagcattttatgtgggtaatctggtttcctcccaaatcccaaagatgttctcattaggtgaactgatgtgtctacatggtccctatctgaatgactgtgggtgtgtgtgaatgcaccctgtgatgggatggcatcctgtgtagggttggtgcctgggataggctcgggcttattatcttacttgtttttattaacctttctgaaatgtatgtgtagattacaattatttcaatgtttaatcttcacagtgttttggtttttattcagaagtttggtgatgtttttgtgaccagaaatatgcgttaggaacttagctcttgtttataccaattggcctatggtaaaattggttttgttatttgtcttttcacttaaagttgcagcttctgagaacctattgacaatgctaaaatgaggacttactattaatatattcagcagtttgacaaagaaggattacaatgtttctttgtattctttatttgcattatttctgatgtgtttatagtgggaagattatatttccattcagcttacaagtgttgaaagagagcatatgtgagggcattggttgatttatttaatagttctgtttctatagcatgaaaaatattatgttttcatcagataacgagttaagtttgaaccctccaccactaactgcaaggcacttgcctctcagcacctcactttctcatgtgtagaacaaaaggtttatattagataacatctaagatcatttattatgtaatggctagttctgccaaaactacgatccagttaacatccttccacatatctttaaattttactttttaatttagttttttgagtatattatagctaaaggtaagactttttttttttttttgaggcagagtcttgctatgtcacccaggctagagtgcagtggtgtgatcttggctcatggcaaccttcatctcctgggttcaagtgagtctcctgcctcagtttcctgagtaggctgggactacaggtgtgcaccaccacacccggggaagttttgtatttttagtagagatgaggttttgtcatgttgcctaggctggtctcaaactccagagctcaggcaatctgcctgcctcagcctccaaagtgctgggattacaggtgtgagccactgcacccagccaacgtaagactttagttgatactcattgtagtaaagaacaagaatcaactctattaattttagattacttagacttttgttgccatgaataattgtttaagagaagtcctcaaatgtgtttcatatactcagaatacaaatgaaagtaggactaaaaatatttctaatcaaattattttttatttctaaactgtagacaaaggccaaaatttgtttttgattataacactttagactagttgaacatcagacatgggcttatatattgcaaaacatagaaaaacatagaaaagtcacaatgtatcttcttgtgggtttttcataatgtcaaaactaaaatgaatttgcctataaagaaaatggagtcattgaataggctgtgtataaaagataagcccagggtaatgaagactgtgttgtcccttgaaaattaaggccatttgacacatttgtatgcatcattagtaagaatctgaaaaaatatcaattactttggaggaccaacaaaggagaaagttaagataaatggaagtttcatcatgagttggatatctacttaagtttatacttttttgaaagaacattttaagattcagaaaatccaaaataccgtatcaacaaaaaaatctgtaaaagtcattagaagcagcactagatttgacaacagacaaaaaaagagaagcagctttaaaaaaggtgagtgcatctgaatacaacaaacaaatggaaagattaatgcttataagaccaagcacaaagtataaaataatatcagaaaactatggacacaaacagaatcttataaaatattttagcttttcaaagtctaataagttaacaacaatattgctacagccctgtagaatttacaagtgtgtcattttcattttctcacataatagttacagcaattttttagatgattattgtattcactttagagttgagaaaactgagtatttcagaaggcaaatgacttgcttgggattatacagctagaaagtagtagaactgggattggcatcccaatctccatattttaaatcttatgctcttagtatgatatcatgctgttctggaggtaattataaaaataataagagttattatttactgaatgtgttctatgattaataactttccttagtgcttcgtacaggttattttaccgaatcctccagtcagtgaagttgtcatcatcactgggaagttagataacttgcacatggtcagacacacctagtaaaagctgtagtgttgagactggcctgaggagtctgagctcttggccctaggctatcctttagaataaggtaagaaaaggaatccaaactcaggactttggtttggttcctacaggaataagaactttcctgagtactaaattagaaaagatatggagagtacctgccacacgacagagtcaataaacattacttttccttcctttttttggggaaccatttttatatattcaaatggtatattcttttttttttttttttgagatggagtctcggtctgtcgcccagggtggagtgcaatggtgtgatctgggctcactgcaacctccgcctgccaggttcaagcaattctctgcctcagcctcccgagtagctgggactataggcgcataccaccatgcccggctaattttttgtatttttagtagagatggggtttcaccatgctggccaggctggtctcgaattcctgacctcatgatccgcccacttcgttctcccaaagtgctgggattacaggtgtgagccaccgcacccagcctcaaatggtatattcttatcctggctctgtcacttactttttgtccttatttttgaccttcgcaatatacttagtatttgtaggccttggtttcctgattttaaaagttgctctaatgtttacctttcaagattattgttaagaataaataacatatatctcactaacaaagagctcttcaaaaaaattaaaactattataggagactgacagatctgactacatgaaaatataaaatatctaagtgttaaaagtgaacaatataaaaaggtacaaagattacttagacttctgttgctgggactaattgtttaacagaagtcctcaaatgtatttcatacactcagaatagtaatgaaagtagaaggactaaaaagatttctatatcaaattattttttatttctaaagtgtagacaaaggccacaatttgtattttgattataatgcttcagactagttgaacatcagacatgggcttatatattgcaaaacacagaaaaacagaaaagttacaacgtatcttcttgtgggtttttcataatgccaaaactaaaatgaatttgcctataaacaaaatggagtcattgaataggctgtgtataaaagataagcccagggtaatcaagactgtgtcatcacttatatagatgtgtgtattgggggtgtatcttacagatggataatcaacacacattatactttggaagataatgaacaaaagacctaccaaagaaaaagaaaaaacacacaagtgtctaaatatgtgaaaaactgttcaatttcactgttaaagaaacacaaaataaacaagatgcaactttttacctatcagtatggctaaagattaaaagcaataatattttaagccagtggttcacagtgtggtccctagactggcagcatcagcctcatctggaaattaattacgtgcaaattctcaagccccaccacagtctaaaatcagaaatttgtagtagggcccagaactcaaatttaacaatccttctaggtaattctgctaaagtttgagaaaactattctaaggtgaagttgtaatgagacaggtacttcatattttactggtagaaaagtaaatggatagaactctagaaagcagtctggtaatatgtgtcgaaaacctcaaaatgttcatattatttcacccccaaattttactgttaggaatattccttaaggaagtgatcaatttctgatcatttcagcataatttaaaatagcagagactggaaataaccttataactatatataaaggaatgggtaaaaaaaccaaaaacccaactatggtgcatccatgtgtgtagataaagagattcacatagcagagttactagaggtaaatatttttaaaaatgttaatagttatctttctggttgtggggttacactgaccttctacatagcaggactacaggaaatgtaaacaaagggaacaatggtttggtttataagaatcatttatagataaccacattatagtttctctgaataacagtgtaatcggaagtgatcagtttccctttccctcctttttctttctgtgctcttatccagtgcccacttgcaggaggtatcagtctctccttcatttctctgttgctaaaactacttttttatgctctgtttcaaatgatattgctccttctcattgtttattctttttatcctatcatttatgaatttagaagctgaattttaaactgcaaaagtttagaattatgtttaaatacacatggtaagtgttactcaaacagatgtcaaaatataaaattgtgtcatgcacaataatgctacagttgtactacagcatagtacaactcaccttggagtcaaattaatctgagcttaaatctccgtgccattttctaattgtgtgaccttggacatgttatttaagtctttctgacttacagcttctataaggtagaaatcataatacttttcaaaggtaattttgtgaaaataaatgaccatatccacttagtgcctcatacagagccatacagcgtagcaacaaaaatttattaattcctttttctctttttacccatgacagtataatataatgagttgatttcaatttgcaaagatttttaaagagctggtgacagaatgcatttctgttacactgttgatatgagaatgaatgttatttacccacagtgaatgctgtctatggaagatccccacagagatccacttaattgagttatgattatatatctcatctcaaaatttgtaacgtttccatattttccatatggcattattttaattatttaagtttaattattttgaacagttgtcttcaggctttgtaagattatcacaaaatgatatagctgcatttattttaggtcaccgacatcttcattaagcagaatagcatacaatcctatcaagttcaaatctacaaaaatgaatctgaaaattaaaataaataaatgacaactagtgaacttccataatacatataaaccaaatgaatattcttaataatcttgaaaatcagtatgaaaaaccaaagcaaccttataaaaatggcaaaggcttttgaacaaactgggtagtaatcatatgaaaacatgattagcattgcccataaagaaatgaaaatcagaataataatgagatatatttttaattcataatatcagcaaaatatctcaaagacttagatcagaaaaacagatcctctcacataatattggtaaaaatataaattggtacagtcttttaaaaggtcatattgatattatcaaaagtataaatgtgagtactctttcctagagcaatctgatttctagaaatttattgtataaactaaaatatatactatattttatttattttaagacacatatttttatattttaacatttctgaaattagaatgttatgttatcgtttaattggcactattttttttctttcttggtgtcatataaaataattgtgttttttagaattgacagactcagatgaaatatggtatgtaaggatatattattgaagcactgtttatcttggcagaaaactagaaacaacgtaaatatctataaaatgcaatactccgtagccattacaaagaataaggaaggcattacggtagtatgaccatgatatattttaagtaaagacatcaagttatagattgatgtgtaaggggaaaaaaaagatgaacactgggtgtacatttgtatatgcacattaagatagcttttataatgaaatactttattaatttgatgctaagaaagtatctggaaagccaacttaatctcattagaaaagagtcatgagcagaaaaacttaaaatgaaattcaccttttcgctggtccatcccatgcctgcaaggaaagccatgaccaacgtgcacagtcctcctgatccagggaaaccaaaatgcacactgctgaacacagctagcacagacaaccccaacacaaggaatgttctcttacacacaagtttgtcctttaggagaaaaaaattcatttgctcaattatttcaaatccctgatttttaatgattgattttttccatatctaggatttagaaagaaaataaaaattaaaatgtctatataaatagacaaaacaagtgcactacataacatttactttctcttcttaaacaaaagcagagttagcacactgcaatggtgagctcttctttcaggaacaccaattctctcctctacagttatcaatgcagaatttcacagcacttaatgaagtagcagaaaaaaagtacatgagctttggagctggacagaccaaggttaaatttatagtttttatacattgttggtgtatgtagtagccacattacttaaccactccaagctttgtttcctgaaagcatttacatcatagggtttgtgtgaaggttaaatatatatctctattattttcaggctctatgtttactgttttaaatttgacgcccccttggtttttctttctaaatctttggaaaccaggaagctttaagaggttctagactgacagtagtttttgttgctgttgttttaaagtctaagaattgtgtactttttttccctttacttttccctgtccaggcttttaaacttcttgatcactttagaaagtaggtctttaaaagtgcttgacttggcaaaggcatgcaagctctgaaggtgaattacctgagttcattcccagttccaccgctttctagctatgtgaccttgttcaagtcacttatcctgcctaagcctcaatttccttatcagtaaaatggtcatagtaatagaaatctctttatgaactattttgtcggttgtactagagcagtgttttccaatagaatgtttagtgatgatggaaatgttctgtatctgctatagccacgtgtagctagtggctactgtactgaacaaagtggcactagatgatgattgactgatttatgtatgtgtgtatgcatgtatgtattagatatgggctcttgctgtgttgcccagactggactcaaactcccagagggatccttttgcctcagcctcctgagtggctgggactaccaggcctggctagaatctaaggtattttgatactaaaaaagggcacaaaaaagctattatatatctgggtttagttgagtattatgaacacttaaaaaacttgcatatcctattactttggaacgatattatttgttttacagtggaatttgaaatgtacagaatataatacgggaacccattacaggactgcattaaaatcttctatattgagcccacttcataaatctcatggatagcagtaagcaattttaaaatgaggaaccatttgctcaaacatgtccttcacatctgtctttgaaggaagtgttctagaatgttttcccaatgatatttcagagcacaactttcccacatattatttctttcacctggtcacggcttggaaagtactgaatgaaaaatccaagaacagatccagttgccacaccaattaccacctccaaaactcctctgaggacattaaagacagtagagcctgaaaaatatattaaaaaaacttagagctctaaatccaacaaatacacaggttttattccacaatcatcaacatgaagcatctaattacaaagaagaaacattttaaagacagtttctgctttccatattcttaaatatgtaagtggaacctacattttcccccatagcatataggatttaggaaactttaattaaaaaaaattttttgttagcacattgtgcagaaaattatattaaagtttctccacacataaagcacttcttcacagactgtcctaagaaaaatgtactaactggtttctgtggtctcttgttattatggcaatcattcttcttatctaaataaaattacctctgaagtaattttatttagctaggatcgctttctaccaggtaatgctatgactgttaaaaacatctagttgtgatagtagcattatgcttaagctattgtggtaataatttactatgaatgtgtagaaagtagctaattagctttagtctctggtatattgaggtgattaaaaaaaaaaagtcttgggccccacccctaaaaatctgattcagtaagtctagcagggctcagatccaaaaggtctaaggaccacacgtagttggtgggggggtggggcggggagaggaaacacagcagagtcaactaggaaggttcttcgagctgtagcttatgaaaaccccactgcctctttcctttctcctcccaccaccatgattctaatgcaaactctgttgctctaaagctgtggttcctattccaagctgcactggtttccactccaaaaggttctgatttaattgtctaagataggacctacataagagtatttttaaaaatcgcccaggtaattctagtgtgatggtaaggctgagaacaattgttttaaaggtatataccaggaaagtggtaagaacataaatttgggtatgtgtagtagcattaaaaataggagtatgaatttgacttaataggtaagagagcatcctcaaaggttcttgaacaagaaagtaatgtaatgaaaacaatgttttaagaaaatcaatttactagggaatggatggaaggcaggctctggagcaatgagacagggtgggattctaggtaacaggcataaatcatacacaatcacagaatggggagataactatagggagataacgagaatgtataacctgccaagaagatgtgttcccactacagaatctaaagctaaacttagattacaattatactttgtcaatcatataatgttgcaaattttatatcccaattttgaacataagattaagaaatgaacttaaacttgtgctgtaccacaggataataaaagtgttgaactgcttttggccttttggctaagatcaagcgtactatctgttcacatcagtttaatataggtgttgaacaacagtgggagaaaaaataacttaagttcctcttttactatacttgaaacaaaatacctcaatttcagacacttactaagtattaatgggacatccattaaaatcattgctgttattacccataaaaagctgaagaggagagaagagaaatttttcttattttaaaggcatgctgttcctttcacttggactgctctctgtcatttgtgctccttgaaaaacccactcatattttgtgtgaagtctccacacatcttttgtgtgaagtctccacacatcttttgtgtgaagtctccacacatcttttgtgtgaagtctccacacatcttttgtgtgaagcctgaacgttcctggatcacttcaagcagaaactgttctttaaatctttctaccttctaccgcccctgccgtactgcacctactgcatgctacttgagcagtctctagagggagcaagagagtaaagacagacagcttctggaccctccttaggtacagaactcttagtgttcttttgcctatttttaatttgccttaatcaattatcaagcaaatatgtcatgcttataacattttaacctacgtccctagaatgcaagagtaaagcctgttgtgaactgattaggttacctgtggaaaaggctatgcccaagcatgtgttgaagccagtgatggccagaatgtcatcgaagctgccagctgccatgagcaaggttgggacacccttctcaacaccatagcctcctccctgcaaaaggagcattgaaggcaccacaacagctggagatacagcacctaaaacaaaactaggcagacagcattttaaacatttatgataacatcttacttattactattttgaaattataatgccctccactttttaggggttatacttggacaacaacagtctttctttttttttttctaaattaagaaaacaaactttaataagaattgttttttgtttttttttcttttttttattatactttaagttttagggtacatgtgtacaacgtgcaggtttgttacatatgtatacatgtgccatgttgttctgctgcacccattaactcgtcatttaacatcaggtatatctcctaatgctatccctccccccctccccccaccccacaacaggccctggtgtgtgatgttccccttcctgtgtccatgtgttctcattgttcatttcccacctatgagtgagaacatgtggtgtttggttttttgtccttgcgatagtttgctgagaatgatggtttccagcttcatccatgtccctacagaggacatgaactcatccttttttatggctgcgtagtattccatggtgtatatgtgccacattttcttaatccagtctatcattgacaactacagtctttcaaatggcagagaagcatgaatccagaaaaacatgtatgtgtaaaacttctacagaacactgtttttcaaaatgtagccatagacaacttgcttcagactacttaggttgcctaaaaagatatatttattagtggtatagaaggcctaatgagggtaggccccaggatgctggcttttttaaacaaaaaaattcatgttataaggtttgaaaatgcatggactttctgatttggaacccagtgatgctaggccttctattagggcttgctatgtcaaataaggcaacagattagaagaaaacgatatgacagtcacattgataccagtaacaacagcagtggtaacagcagaaagcattttacagtatttactatgtaccagacaccattttgagcactttacacgtattcactaatttaatcctcacaacaaccctataaaatagacaaaatctatcttaattttataattgaggaaactgaggcacagagagattaaatacttgttaaagatcacacaccggaaaaatcacaaggctgggatttgaatccagggagtagagttccagagacttaaccatgagaagaatttcttacttcttgcctcttattagcactaaattcttactaagtcctgtcttatttatttactttgtgtggctcttaactgttggaagtaaagaactgacagtggaacgaagagacagcagaactgccaagtcataatagtctggtgacaggaggaaaacaatagtagctgttgatcactgttgctgtgtttattatcctttgtgcagacgttaggtggaatccggtatctctttaacaggcattgaatcaggtgtaggcaaaagaccacgacttcttcaacagtttgaatagtaggtgctaactgtaagagttagcgcctattaacacataaactatgttttgaagttagaatatttaaattatgctgtaacatctatgttgcattttctgatatctataagaaaattctattatgcattctcttgtatgcaatcagggaaagccctaaatgtccctacatattttcatatgacaaagaaacaatcattaccccagtataaatccccattgccatggtaaacccagcaggtaatgggcaagaagagcagatgtgcacgcctccacaatacagggacccatggacagtcttacacaaacgccctttaacttcttcagggcctgaaatagaaaagtagacatcctaatataatcctctgaagatgtgcagagaagatgaccttgaatgctttctcttcagtatatggaccacgtctgggtcatcatgagttttcaaggtaatgagttgtatttaacaaacattttagcactccaagtgttttcagacagcttattaagtcctcactgcaaccttataagataggtaatactattattatccccatatttttagatgtcctcatctgaaaaggcacaggctaaaggcatttgcccaagatcatgaaactggtgagtgatggggccaggtttgaacccaggcaggctgctttcagcatctgtgttcataatctctagctaatttaacattctcattagttttatttataatttgtggtcccagaatgagactaaagtgaagagcctgatcccccaagaaaattcattcctgtattcaaaaacatacatgaaaaaaaagcattaaaaaggcatacttgaccctcattttatatattaggcagtttcctgagctagtatagttagccctgaacacttgtatagggctttgcaaaccaaaaatatgttgttttctcccctgtgagcattatttataaccctggtctatatgtacatcagagaaaagtggggcctttattcttggtgctggccccatagacagactctacctttctccaaggaagagaatgagaccggctgggcgcagtggctcatgcctgtaatcctagcactttgggagggggaagcaggcagatcacctgaggtcaggagtttgagaccagcctggccaacatggcaaaaccccgtctctactaaaaatacaaaaattagccgggtgtggtagtgcatgtctgtaatcccacctacttgggaggcctgaggcaggagaatcacttgaacccgggagacagaggttgcagtgagctgagatcaagccgctgtactccagcctgggtgacagagcgagactctgtctcaaaaaaaaaaaaaaaggaagaaaatgagaccaccttttgagttattgcaaaccacaacaaggtctcacttgcaaaacaatcctccatgaaataaattctattttattctcaagaatgtcatgcaaagtgtccacatccatttcctaatgcttagtgattctgttagatacctgaagcattgaagaaacaagattcctatttaataatgagaaatttacatttcatacctttgaatccagaccaaggccagcacgaaccagaatgatagacagggctatgcttctcaaagaggaagaccacttgtgcttgatctgcacattatcgttgatgactgggatatttctgatgagaaaccctgcaagcagcatgccttgaacgaagaaatcaaacatatctagttagttttcaaatacagaaaatatttttagtactttaattttatacagactactatataatcccaggaaccacttcacttatgcttagaagaaattaagttaaacttttaagtaaaaattagtataataaagcagctaagaaaataatgtacagataaaaagatagattataataattaatattcccaaaataactgaacttaaaagggagacaagatgcagcatttggatagagagtatgatcaaattctaaatataaaatgttttaatacaatgccagctcagtcagccctttgcgtgcaaacagcaaacagcgcatgaaattatttgctatgtcagattacttgaaatatcaataaatacttatatggattctattttaccttcagattagataatttcataagagacagataatctactttgcaaaggttttagatgtcaattatgatgaaatggacattgccctgtcatgtcagctggtgactcttctttcactcagtcattcaactgtactgaatgccttcagtagtttagacactagagtatgtatcacacatataataatggattacatttcaacaagctttcagcctctagggaacaagacaaacggacaataccaattttatgaaggcatgagggggatgttacatgagctgaggcaggaagggggatttagagaagggggaagaggatgaagaaacggctaggggagttgagaagtttctggaaaagacagtagtttattcaaaggtaaaagaaaaagtgactcattctgaaaactgcaagtagttgagtgtaactgaggaagctgagtagttagtgagggaattctgccttcattgataccacatgcccacacaaagggaaaggtttctgtgagagactgagcctcttccctccatgcttctccagcagtgccctcttctcaccttgtccctataagcaccacacttcaaacaactaaataaatttactgaagttaggttattttgtgatgcaagatgggagaagagagacaacctgctgcacatgaaagcatcactccaggtatctctcatcactgccatttatctacgggaaagtctcgtaagttctgaatgctgtggcagtggtctttctggaatgtttattgggcaacaatatgaacaggcttggtttttggaagaaataatgatgagttatatatgcacatggtaaaattaagacattgctgacaaaatgtaaagtgacaagtacatactgtaccccaactgcaaccttccatcttcattcctgaatgtatttcactgttaagggtcttctgtgcccttccagaaagtttctgtacctattcaagtatatttctgtgtgtataagctcttttgtgctggacacaaataggacacttatacactgctgtacggcttgggtttttttcccatttaataatatatcctggacattttcccactgaagcacatatatatttgctttattctcttttaataactggaatagtatctcactgtttggaagttccataatttttggaccactaataatagattttaagaaacttttcaggtttttcattataaacagtgctgaaatgagcacaattcatacatcaagtatttaagtgcctgctacatgctagccctgtatgagatcctagtaacaaagaggtgagctagaccagcagtccacagcctttttggcaccagggaccggtgtcgtggaagacgatttttccactgatggcagggggaatggtttcaggatgaagctttccacctcagatcatcaggcattaattagattctcataaggagcacacaacctagattccttgaatgtgcagttcacaatagaactcatgctcctatgagaatctaatgtcactgctgatctgacaagaggcagagctcaggcagtaatgctcgctcacctcctgccacggcccggggcttgggcacccatgagctagactaatgtggtccttgtccatatggagcttatatatttgtaggtttacattaactatattcatattataatttcaagcagtggaaatgttaggccctatggtataggtatatgtcatttttatatatattgatagcttaacagccaaaaatactgcactaatgcttacattccattatcattacaatagctctttaatgaaatttaaaatgtgtttctaagccactcctaaattaacaatggcattcaatgacctgaaatcaaatggaatatcctaagaagaactcaaaactatgttaagaggtttttttgttttgggggatatgaggggacatttttttttttttttgagacagggtcttgatatgttgcccaggttggtctcaaactcctgggctcaagcgattcacccaccttagactcccaaggtggtgggattacaggtatgagccactgctctctcttggcctgagagagcatttttcattcctgaaatgaacgtgacagcagcttccctgggacactgtttcctttgctagtggtctggttgatgtaatgtgaccacctgattttgatttggcacatgtccccactcttgcctctagggcctcccctggtcatggaggaaagaacatcttcctggatagaggagtgttgttctcttaaaattttgtattatgaaaattatcaacacatggctaatctcatttcatccactcccaagttttttttttattatttgtgttatggaaattttttcaataatgatttttcttctcttccaaagggaagccgttttcaaattcatttcaggaatcaaaaatgctcactcatactccgaccctggcaatcacttcaattaaactcttaaaaatatagaacaggcaaccatcacatacattttgtcttaataagtttcctttatggattcagataatgcttcagttttggatactggccttaatgtaataagaaccagtaaactttcttcctctatgcaagtatacaactataaaaaagaatggtaaaatacatatataatttttgagaatgatttcagttaccttaggagatttcattttatcacaaatcccaagactttacatctttttgcaacatggtatattttgtttttgcaataggcatggagtgaaaaaaagacaaatggggtgtaatgggcattttcatgtgtctagaacaacagtcttcaacataggttgcatattagaatcatctggagagctttttaaaacttctgatgtccaggccatattccatttcaattaattcagaatctctggggtaagacctaggcatcagctttttttttttctttttttgagaccgagtctcgctctgtcaccaggctggagtgcagtggtgcggtttcggctcactgcaacctctgcctgctgggttcaagtgattctcctgcctcagcctcttgagtagctggggctacaggtgtgggccaaccatgcctggctaattttttgtatttttagtagagacggggtttcatcatgttgggcaggatagtcttgatctcctgacctcgtgatctgcccgcctcggcctcccaaaccagcagctttttaaagacaggtgattcctggcctggcatggtggctcacacctgtaatcccagcattttgggaagccaagatacgaggattgcttgagcccaggagttcaagacctgcctgagccataaagtgagaccctgtctctgcaaaaataaaaaaggtgtagggacatgtgcctgtagtcccagctactgggaaggctgaggcaggaagattgtttgagcccaggagattgaggatgcagtgagccatgattgtgcaatgattgtgcaactgcgctccaccctgggcaaatgagaccctgtctcaaaaacaaaacaaaacaaaacaaccaatgagagattcttatgtgcagccaagttctagaatgaatgatcttgctacataaaatgcgatcttagagcttagaaatgcagaatctcaggccatgaagacctacttaattagaatttgtattttaacaaattccaaggtcatcctctttacaatgaattttgagagtcactaattttgatgcaagggtcagcaaaaatgttctgtaaagggccaatgaatatcttaggctttgtgggctataaagtctctgttacaacttcacaactctgccagtataatgtgaaggacatagacaatatgtaaatgaataaacgtgggtgggttccaattaatattaatttataaagagaattagtctgcccaccctttatcctagcatataggcatatttaaaaacaattcattttaggcgatcattaaaaagtcaggaaacaacaagtgctggagaggatgtggagaaataggaacacttttacactgttggtgggactgcaaactagttcaaccattgtggaagtcagtgtggtgattcctcagggatctagaactagaaataccatttgacccagccatcccattactgggtatatacccaaaggattataaatcatgctgctataaagacacatgtacatgtatgtttattgtggcactattcacaatagcaaagacttggaaccaagccaaatgtccaacaatgatagactggattaaggaaatgtggcacatatacaccatggaatactatgcagccataaaaaatgatgagttcgtgtcctttacagggacatggatgaagctggaaaccatcgttctcagcaaactattgcaaggacaaaaaaaccaaacactgcatgttctcactcataggtgggaattgaacagtgagaacacatggacacaggaaggggaatatcacacaccggggcctgttgtggggtggggggagggaggagggatagcattaggagatatacctaatgtaaatgatgagttaatgggtgcagcacaccaacaaggcacatgtatacatatgtaactaacctgcacgttgtgcacatgtaccctaaaacttaaagtataatttaaaaaaaagaaacaattcattttaacaataatacaattaataactttagagaacaaaaagtttccatgagaaataatatgaattaagtggactatctttagttttacctaaaattagaaatacattgagaaatggggcatagtaagagataaataattctacttctttttatatttaactttaactactgaccacaagttcaaaagcagataattttggtgaatgttagcgaatcctgattgttctcactcatacagctaacagaaaaaaaaaaactgttcaggaaatgtgtgtaaatatatatgcatgtatgaaaggtaggtggttttttactaaaactgagtgattaataaatctgttagaaatgaacacaaaatgcctctgtggtaaacaaattttataatgcagaattcttttttttttttttttttgaggcggattctcgctcggtcacccaggctggagtgcagtggcgcgatctcggctcactgcatgctccacctcccgggttcacgccattctcctgcctcagcctcccgagtagctgggactacaggtgcccgccaccacgcctgactaatttttttgtatttttagtagagacgggattttaccatgttagccaggatggtctcaatctcctgacctcgtgatctgcccggcttggtctcccaaagtgctgggattacaggcgtgagccaccgcacctggcctataatgcagaattctttgaagaaacgttaaaggtatcacacctagttttaagactaatttgtgtatgtgtcttgtttgggcagttctcattgcctctggaagagtattttcagctatgtctttaagaatcatggtattttatttcatttttatcttttttgagatggagtctcgctcttgtcacccaggctagagtgcagtggtgtgatctcagctcactgcaacctccacctcccaggtttaagtaattctcctatctcagcctcccaagtagctgggattacaggcacccgccaccacgcccagctaatttttttatttttagtagagatggagtttcaccatgttggccaggctgatcttgaactcctgacctcaggtgatccgcctgccttggcctcccaaagtgctgggattacaggtgtgagccaccatgatcggccaatattatattttaaatatacccaatggtgtgctggtaaatgcttaacaggtggcttgccaaaaaagtatgcattttatataggcacatacattattaaattttactgatataaaggatgtgcagcacacagtttacaaatatacaaccatcttcactgtaaattctatatagccaatttattctcacagaatgttttcactgctgtttgtcaaacttctgtgtccataaccatctatggttgcagttctaccaagatttgacagaatcagactacaaataaatggttgcatactatctgattcagcaaagaagtcacatatcatgaatgagcaagtgcagtgttaccatgaatgttggttgatatttttgcttataagatgaaaatgaaacaataaaaatacatgtcagaacttcactctgtcaatgtcataagtgacttatactatgacaaactttgatttgtagcatttgctgattttttttgttgttgttgttacagatacttctaccatggccgattttaagctacaacatgatgtcactgaacgtggagttgggaagaggtggcagtggcacaccattatgtagtatttccataatctcaagagcataggtgaggggaaatagactaaaacattaggaagtcttcagtgttgagcactgaatgcttgtttttaatgtcagttaattttaagtatatatatatatatatatatatatatatacacacacacacacacatatatacacacacacacacacaaacacaaacatattttgagacaaggtctcattctgttgcccagattggagtgtaatggtgcaatcatgacagcctcgacctcctgggttcagtcaatcctcccacctcagcctcctgagtagctgggactacaggtgcacgtcaccatgcccggctaatttttgtattttttttgtagagacagggtttcaccatgtttgccctggctggtctcgaactccagagctcaagcaatctgcctaccttggcctcccaaagtgctgggattacaggtgtgaaccacagcacacgggccaggataatttaattttttaaattgctatgtttaacaactagattacagaactactcaaaatttaacaactggcttttggctccagcatggcaaatacagaaatattttattcctttatttcccaaagctttccaaactattatcttaaaaatatagtttactctggatagaacaggaaacatttagcacttaccaagaagagaaggcagtggaggcaatgtaggtaacttaataagccccaaaagtttaccaccaatgatggcacaatagaataggattataattccaaataggtttcctccaggaagacattcactgccagtaattgaccaaactacagcccacagaagaacaatgatggtaactgaaataaaccaggaatactagttactatcaataagttgtcacatggaggttttgacaaaatctaaaataatttgtaaaaataaatactgaatgaaaatgcaaatatttataatcatgtttaatctgtaaagagtatcagtaagatgaccaactgggtaactgccaacatcttaagaaatcggatattaccagtacttttgaatctgcctatgtgcccctccccatccatctccctttatactgccagaaggaaccattattttgactttcttcaccattcacttttttctttataattttaacacaaatttagttctgtcttgaattagacattattgttactttttttatagtcaatatttgtttagaattacctactaaggtaccttttttgaaatcatcattcattatggcatctcaaacttttctttctttttgttttgaaacagggtctccctctgtagcccaggctggagtgcagtagcacaatcatggctcactacagcctcaacctcccaggctcaagtgatcatcctgcctcagcctctcatgtagctgggactacaggtgtgtaccaccatgcctggctaatttcttaaaaattttttagtggagacagggtttcatcttgttacccaggctggtcttaaagtcttgagctcaagtgatcctcctgtctcagccttccaaagtgctgggattactggtgtgaacctcctcatccagcctcaaatttttcatctgggacaattatcctgctgcctaaagcatttcctttaggaaaagcatttctataagaatgtgaaataggccaggcatggtggtttatgcctgtcccatcactttaggaggtcaaggcaggaggattgcttgagctcaggagttcgaaaccagcctgagcaacatagtgagaccttgtctctactaaatataaaatataaaaattatctgggtatggtggtgggcatctgtaatcccagctactcgggaagctgaggcaggaggatcccttgagcccagaagtttgaggatgcagtgtgctacgattgcaccactgcactccagcctgtgttacacagcgataccctgccaaaaaaaaagtgaaatgtttccatttgaaaacttgtgttttacaaaactgtgcactaaaaattgaaaagtttatgggaaaaagagagttggggcagaccactcaaaactggtggccaaagcactaagaaaaaccaaaacaatcctaataagagtcttagcacagatgaatctacacactgacatttgtgtcccatacaggcagtctgttctttacagacttaaacctggcctcccatttcctacttcaagatggaaattcttgagggtattttctttaaacagagagcagttccatcaaaatctgatccatattttagccctctgcctcaatacaataaatttcaacaaaaggaaaagcgttggcagcttctttacctcagcttatactctcagccgcttcatccacatgtgttttattagatagcttaatgttgtagaatgtttgagtccttgaagcccctaaaccagctactaattgcatgaaaagtcagcacttccacagagatttcgtcctttaaaaggtcctcatgcagggaaggctttatctttaattgtaagaaagcatatatttggtcttttcttccccagttcactttgccttcacttgctattgcttgacgatacaaaatattatgggccaggaaaaattatacacaaaactgcaaattccatacactctaacaaaattctatttaccattgcatatgagctaattcatgacatagaaacactctgtatcacagcatgttgtatttctcaggagaatctgttacagtaaattcttagttgtatcatctggaattatctttattctcattcttaaaggatagtttttctaggtatacctcagttttatgttaaattctaggttgagtgttattgtttctccattccttgaaaatactattccttggttttctggttttgaagagcctgatttcagctttttaaaggaattctttttccttgttttcaacatcttctctttttctttggttttcctttcagtatgatgtgtttaggtgtgacttccttttgttttgcttaagatttatgttttttaaaaaaaatcagttctggaaaattcttagcctttatttcttcaaagatttcctcttccccattctctttttccatgttgctaaccctagttttcgtatctttcatctttgtgtgtactgcattctagataatctcttcacatttatttgccagttcaccatttttttcacttaatctgctgcctaatttgtccagtgagtttttaatttcaattactatcctatatctttcatttctagaagttcaagttggttcttcttcaaatctattcatttttaaaagttacttgttttgtactcatgttttctaattcttaacttctttatatatataaatgtcttatattctgttttctgataatgtacatttttgaaatctgtttttttgtttccttttgcatgttttttttgtttgttttttttttttttttagtttttttgcaatagtgagctctcccttggaactttgtctagtttgttttttgcaatagtgagctctcccttggaactttgtctaaaactaaactttttagtttgtcttttgcaacagtgagctctcccttggaactttgtctaactttgttgaagccttaggttgaatgagttttcccagatgggaatgaatttacttctaccatgtacttaaaagcttcccatccaagaccatctgaaaatgttttttgaaaatagatacattttcaaattgaattttttctgtgaaattggagacaaatcaggatgaagttaaacatttttattggcgactccacacctgccccagccagcaactacagttgagacaggtttagtcagaggccccatctgcagaacagatttacctcaaatttggcatcacactgggtttcaactttatatgggtgaaggagaatgctttttcctgttagacttctcccaacctgggcaggctctagcttagcctcctgtgctcacagcgctctcaaaatcaatctcaaattccctgaggtggatctagaactagaaataccatttgacccagccatcccattactggtatatacccaaaagattataaaacatgctgctataaagacacatgcacacgtacgtttattgaggcactattcacaatagcaaagacttggaaccaagccaaatgtccaacaatgatagactggattaagaaaatgtggcacatacacaccatggaatactatgcagtcataaaaaatgatgagttcatgtcctttgtagggacgtggatgaagctggaaaccatcattctcagcaaactattgcaaggacaaaaaaccaaacaccgcatattctcactcataggtgggaattgaacaatgagaacacatggacacaggaaggggaatatcacacaccggggcctgttgtggggtgggggtaggagggagggatagcaataggagatatacctaatgttaaatgacgagttaatgggtgctgcacaccaacatggcacatgtatacatatgtatcaaacctggacgtcgtgcacatgtaccctaaaacttaaagtataataataattaaaaaaaaagttccctgaggtttggtagaaacctccagggtggggccaccttgagtgcttactgacctctgctacttacactttggttttggtgtctgatgattccctgttttcttgacagatcatttcaaaagacttaaaacattttttcagatgatgtccttggtttgtgacaagattgttcattgagtctcatctaccatactgctagagactgaattcaatgtccctttttctaaaccctcacagaattgttccagattttctaggcttatgatactactgcagtggaatacctaagggacttccagtattttccaattagctacaagggttgaaatttctatgcgatatcagaggtagaatgggaaagcaggatttgccagctattatactaaattatactttatcatagcataaacccaagctaatattaaattcagcaaggtagaattaagtgttttctcttttcggctgggcgcagtggctcacgcctgtaatcccagcgctttgggagacgccgaggcaggcggatcatgaggtcagaagttcgagaccagcctgaccaacatggtgaaaccccgtctctactaaatacaaaaattagccgggcatggtggcacgtgcctgtaatcccagctattcaggaggctgaggaaggagaattgcttgaacccaggaggtggagcttgcagtgagccgagatcgagccattgcactccagcctgggcaacagagtgagactccatctcaaaaaaaaaaaaagagagatttttctacttcaagactattaaaaaaatctctctttccctgtgctttacttgaaacacagttgtaaatacatagcaaatggtatgtctataaggtttctctaaatcatgtttaaatcagttaacaatttacttctcatttacgattatggaaaaccacaaattttcacatgtaagatttactttttttatttttattttttgagacagtttcactcttgtcacccaggctgcagtgcaatggcacgatctcaacctccgcctcccaggttcaagtgattctcctgtctcagcctcctaagtagctgcaattacaggcacccaccaccatgcatggctaattttttgtatttttagtggagatgaggtttcactatgttagccaggctggtcttgaactcctgacctcgtcatccacctgccttggcctcctaaagtgctgggattacaggtttgagccactgtgcccagcctactttttaagaagaatactgatatatactgcataggcacaggaaaaaatataggacaaaagtcgtcttgtaaacctctggaacagaagaacagaaaaataagcgatgagatgtttatctaccatgaacctcatttttcaggctgctttatgaacgattatacatttttaaaaaatgtgtcccaaaattacattattcatttttactctttccttatgtcagtccatatctgtttcattgtaaacgttttaactataagtaggccatattttgaataataaaagtttaaaaaaataatgaaaagaacagaaaaggtattcaattatctgtgatcttatcagctagtgtatatttttggattctggttttctgtacatgttctaagtttgagattttcttccatgcttagttaagtaaactgacttggtttcattaaaaacacatctagagcctaaagtatagtatattatgcttatctttcattgtcccagatgataatggtaaacatgtctttcagagcccacaaagtataactatggaattgagtctcatttttcagtaaacatatgtgggcatccatatatttacttcaatgatgctattattcttgaacacaatttttgaaattgcctttaaattttctttaaaaggcaaatttagtaagacataaaattatgaaactattagaaaaaaaacataaataaaaagctccatgacactggtctgagcaataactttttggatatgactccaaaaatataggcaacaaaagcaagaacagacaaaccagattacaccaaactaaaaagcttttgcacagtaaacaatccacggagtgaagagacaacctacagaatgggagagagcagttgcaaactatgtacctggcaaggagttaatgtccagaatataaaaggaactcaaaaaactcaatagcaggaaaacaaataatccaatttaaaatgggcaaagacctgaatttttcaaaagaagacatacaaatggccaaacaggtataggaaaaaatgttcaacatttcacctcatgcctgtcaggatggctattatcaaaaagacaaaagataacaaggggttggcaaggatgtagagaaaaggtaactctgtgcactattggtgggaatgtaaattaataccactattatggaaaatggtatggagagtcctcaaaaaagtaaaaatggtactaccatatgatcctgcaatcccattactgggtatgtatccaaaggaaatgaaatcggtatgttgaagagatttctgcactcccatgtttattgcagtactattcacaatagccaagatatggaatcaaccctaagtgtccaacaatgaatgactggatgaagaaaatatgtgtatatacacaatgatatgcttttcagccataaaaaagaatgaaatcctgtcatttgcaacaacatggatgaacctggaggacattatgctaagtgaagtaagccaggcacagagagacaaatactgcatgttctcactcatatgtagaatctaaaacagttgttcatatggaaatagtaaatagaatggtgattaccagggactggggaggggaggagcttggggttatggggagagagtggtcaacaggtacaaagtgataattagataggaagagtagtttgttctgtaccacagcaacgtgactatagtcaggaataaggtattgtatacctcaaaacagaagattttctatgttctcaccatgaagaaacgataaatgcttcatgtgttagatatgctaattagctagatttgatcattatataatatatacatgtattgaaacatcatattgtaccccacaaatatgtacaaatatgtgtcaaaaataaaaataaataaataatgctgatgaatggatgtttatgtttttgaacaattctttttatattttgatgttaaaattatctttatcttttgaaaatatgatttataaaagtgaaaaattgtggatagattccaggcatttaaaagttggccggttaaaactagttttgccagatgcagtggtatacatctgtaacaagctacttgggaagctgaggtgggaggatcccttgagcttaggagttcaagacaaacctgggcaacataacaagatcctgtctccaggaaaaaaaaggttgggtgggggaggtgaaagtggcaggaagaccatgaccaatgccttgacatgtaattttctctagactttaaatctgaagatccatgaaaaaaaaaatgtacacacacgcacacacacacacacacacacacacacatataactcaagtatattgggtgatatatattgggttgttggtcacaggatacaaaatttcagttagacaggaggaataagtttaagaggtctattgaacaacatgaagactgtagttaataaatatattgtattcttgaaaaatactaacagtgaatgtattgtgttctcaccacaaaaaatgacagctatgtgaggtaatacatatgttaattagctaaaattagtcattccagtatgtatacatacttcaaaacatcatgttgcacatggtaaatacatacaattttatctatcaatgtaaaaaataaaataaattttaagtctcaataaaagaatactgtcttcttaaaaaaacctaatttgcctttatagataattttcaaatctcttcttttttctgctttatcacatattcccccagcatacacagcacagacacacatatgcacacaattcatttctgaagaaaaatagggcataaatcaatctgaacttccatatatttatcaaattgatggcagaataacctttggcttccttcaaagaccaaatccattcctgaaagacaaacatatacaagcctaaaaattttcaaaatagtgctgagataaactcccaaagaaaaatcccccaaatgtcttatgtaacagcaactctactaaaataagctgaattgcaaaccaatattcttacttataaagtaataggattcatctggaagtataaatggggctgtgtttgctaaaatattacttgcattacttaacagtaataacaacaaacgtttatgtagtgttttacagtcctaacgtaatcctgtgaaattactcagatatagtaaaggaaaaggtccttgatctgtgttccttcccccttcccacaatggtggtgaccacagtgatcctgaaagccaaggtgaagacagtggagccctgttagtctaggtccttcccttgaatgtgtggagcagagccacccatgtgtgtgaattgttcaccaactagtttttatgtttgggagaagtgaacttctttttgtcctttcaaccatattatttagtaatctgccattataacaacttcatcttttgccatctctttctgaattcatccttaccatttgttatgaccctgtccagtaaaccatgtggagggcaagccagcatttgtctcagtctttgtacgtgatttgcttcagttggtgtttcttgtagctttttttcactgcttttcaaaagaatacttccttctgttggttcatttgcatctatacctttgagcttcataactgtctcctcctgtgtttaaagtaattttaaaaatccttaaaactgtatatattttacacatatttataggtactgcatcatcaccttacaaatcaaatttctatgactagcatcaaggataacactttgtagaaaaaactcacagctttattactagctaatcagcttgaaacaagaatgatactaggagtatttagcacagtcactatttttagtacaggttgagtatcactaatctggaaatctaaaatctgaaatgctccaaaatctgaaactttttgagcactgacatgacacacaagtgaaaaattccacacctaaagtcacatgacaggtaacagtcaaatgcaactttgtttcatgtacaaattatttaaaatattatataaaattaccttcggattacctgtataaatatgaaacataaataaatttcctgtttagacttgggttccatctgcaagatatctcattaggtgcatgcaaatattaaaaaaaaaaaaaatccaagacacttatagtcccaagcatttcagataagggatattcaacctgtattataaatgcttgggtcacataacattttattatgttttataatactgggttttaaaataagcatatttaagataaaattcagggcaataattggcacatataccaaagtggtttagaaaaagataactatctgtaatgaaaaccacttcacattcattaatctacttgaatttaaacaataaaaaggaagaaaccaaaaccattctagagattaggtcagagacacaaagcgtttcataggctctccatttttctagttacaggtagggtcagctggcaatgatgttagctgggaaaactggtagtcacacctgccttggattgtgtaagtttggggataggagaattggtaaatgagtggtagaatatgaagaaaacacaattctatcacagcttagatttacctgtgcttcttgatgcatggagggcgtgtaattcattcctgtggatggttctgaatcttcatatgtaattcttttatcttcatcccccattatttataattaagaagatgacacagggaagaggaacgagatctgttttgaaagagtatagatatagagcagtaatttgaaagtcttgtgatttcaaagactttggattgtacttatttttttccctaaaaattccgaatggctaaactatttgaaattagactattcttaattttcaatggctggttattgtttttgcttgattctagtatattatcatcattcttatctacctttttatttttcttgaaaaagcctttgttgaccaatcacatttttatgatttctttcccatattattttttgagttaaacttaaaaacaatccaagcaatatcagtgttaaactgtcctctctcatgggccaactggatgaagcaggaagtctccaggtaactttccaatgttgatatgaggaatgagtcactaaagggaaatctctggatttcatccttttcggagaatctagagtcactaactcctgcctggttcttatttctaaattaaagtttaaaaatacaccacaattgactgagtagccagaatgtctcagacactatgatgagtgctatggtagtcactttttagtcattgtgggcaattcaaagattaccaaaacatattgtttgttttccattgacttatcatataccaggaaaaataaatttataccaaataactaagaaaacctgtaagactacggattggctcaataaacactcacttcaacacattctcccttggctttccatgctatacaggctacaaggcaaatacagcactccagttcctagccacttttgtaggtagaggtggccatgtgtcacagttctacatatgagatttaggtgggagttttgggggaggcctttagaagataatactttgtactttttgtcctctaacatttccctttctccttcctagaatgtagatacagtgcctggaagggcaacagacatctttcaagcatgagaataaaagccctctatttaggatagtagataagtaagataggagaagctggttccttgatgacatcttccagttgctccatcagccttggactgccaagcattggggtaattgtttaaaccactattaatcaagttttttcttcttttttaactagtaaggaaacttactcctaatgcaacaagtagaatgagtatcttgatagaggtacacactacaaacttgtggtagaatcaaagagaaaattatgtaagagaagggaaaatctaattcaacacatatcaaagtgcctaatgggttccaggcactatgctagacataaagacaaggatgaattagacaggacccctccctcaaggaatcattttctctgttcaacgaagtgccaagaaatttgcatttaaaacttcaaaaaacatcataatctttttaccacaaccacccccatttttcctacttacaaaacacatggtaaccagagtcccatctcaaaaaaacctttagtttgttttttattatacataatttgtaataaatgtttatataatgatatatatgtatgtgtatgtatgtttgtatatataattttttaaattaaaaaacttatttcaaaatttagactgataataaaaaagtcacttgatgagaaaatgttagactcagagaacacttgtcttaaaggcatggagacatgaaagccagtggtgtgtgaggggaaactgctggagcttgtggcaggaggctgagagtaatgcgagatcaggttaaagagttaggatatcatatctcaaaccacggcacttggcctttaccttctgaagtgaatgaccccaaatatggtaactgacaagatgggctgggttcgaatttggataagcctgaatttgaagtccatctataccaaattgcttaacctctttgtgattagtttcttatttatgaaatggagacaagaatagttctaactatgcacagttggcattcaatagtgttggttattgctaaccatgcatattccttcttcctgattatcataagaagaatctttaagaatcattttgctttccctattaagcaagaaaaagtcacctcaaccttgaagaatttactacttaatcccattgattttatttggtcatgatttttcatctgtttttgaggcccacttcttgatcaggtggatgtaacattcatttcttcacccttctcattaggagaattacatagaaattctttggcagtaccactagaattacctctttcatcaaattctcaaaatcagcccattctgccacttacaaaaactatttttaaatagtcgtgaattagaaattattatttttagtagacaaaaactattggttaaaatgaagcctttgcgaacaaattttatcaatgttattatggggtccttttaaatataaacaatcacaacttggcatgttatgccatctgtgggaatttatataattttacattccagaaaagttccctattctccaatactctcaaccataaatgccaaagtacttatacatgatcagaaaggtactgcagaaataaagggtaaaatgaaatacatgtcttttaatgagcccagtaagagatcttacaactagtcagctgtatttgtttgctctctgctgtgtttccatttctaaaagaccatttaaaatgcatgtctcacttcaggaacctacttaaatttaggaaaatttcaaaaatgttagctttacttaaagtgaccatgttcatggtatttattatttatagtcattgggtcttgaaattacaaaaatgacctttgaagggccataaaaaatgtcatgaaatgcttattagaaagtttattctccttactcatagagaggctcttaaggactcatgcagagcccattaacccttattttgttttgtttgtttgtttgatttttgagacgaagtctccctctgttgcccaggctatagtgcagtggcatgatcctagctcactgcaacctccgccgcctgggttcaagagactctcctgcctcggccttctgagtagctgggattacaggtgcccgccacctcgcctggctaattttttgtatttttagtagagatgggttttcgccatgtcagcgaggctggtctccaactcctgacctcagtgatccacccgcctaggcctcccaaaatgctgggattacaggcatgagccaccatgcccggcccttatttcgaaaacaattctaatgactttgctcctttgtttttcaaaccctcagaagattaggtgttaaatattaaaattcaggaagagattgctgtgatagaggcaaattgagagcagcattagtgactgatgacagtgaaagagatgaaaaagacagcaatctaagagtcatttatagtgggggcgacagagcaagactgtataaaaaaagaaaaaagaaaaaagttttcttaaccttttctccccacttgaaagaattgtccttaagagatcaagaatataagcagtttgatatatgtacctgttaagaaggaaacagaaaaaaaaaatcctttaacagcagttgcctttgggaagggaaatggaagaggagtggctggactttctttcttattttctaagaaagattttcttatgtaggattttcttatgtaatttgatatatatatatattttgttgttgttgttgttgtttttttgagatggattctcgctctgtcacccaggctggagtgcagtggcatgatcttggctcactgcaacctccgcctcctcggttcaagtgattctcctaccttggcctcccaagtagctaggactagaggcatgcaccaccacgcctggctaatttttgtattttttttttttttttttttagaaggagtctcactctgtcaccaggctgaagagggattgcaatggcacgatctcagctcactgcaacctccacctcccaggttcaagtgattctcctgcctcagcctcctgagggactacaggcacatgccaccatcccttgctaatttttgtatttttagtagagacggggtttcaccatgttggccaggatggtctcgatctcttgacctcatgatccacctgcctcagcctcccaaagtgctgggattacaggtgtgagctaccacacccggctaatttttgtatttttaatagggatgggtttcactatgttggccagaatggtctcaaactcctgacctcaagtgatccactggccttggcctcctaaagtgctgggattagagatgtgagccaccctgcctggccctaattttaaatacatttaaaaataatctactcaattcctaaagctttagagaaaagaaaatggtaccacatttcttggtaatatttctcatagatacagtctggtgatttgatttgaggtaacttaataacacctgccacaatttaaaatcattttttgtagttgtgatttttcaaagaagatgagtaactgcccagaatcaccaatagcagtggttttcaaaattttcaagtttggctttcatgttttttttttttttttttttgaggtggagtttcgctcttttgcccaggctggagtgcagtggcgagatctcagctcactgcaacctctgccttccggtttcaagctattctcctgcctcagcctcccgagtagctgggattaaaggtgccggccaccatgcccagctactttttctatttttagtagagatggggtttcaccatgttggccaggctggtctcaaactcctgacctcatgatctgcccgccttggcctcccaaagtgctgggattacaggcgtgagccaccgcacccagccctggtcttcatatctttatgtcaaatatctttcatcaaatgaaacctaatccttaaatcctacaaatggaacgactaaggtggcgctgcaggagccctgtctactcacccctgttccttctggcaagtggagcatactttggaaaccatttctgtaaatatgttttcacatagagagatatttgttaaatgttctctttttcatattatcttactaatgtaaatgtttacaagtactttctgtaatattccagaagaaataaaggaactatcaacttacaaatgtccgtaggctctcggtcaagtaaaatagacttactgctatcatttcagttactgctaaaagatatggataaagactttttattcttgctatttgctgcctgtgatttggataggctgacatttaaaggagtaatcttatggagaatttacatatattgcttgctatggcttgaatgtttgtgtccctccaaaattcagattttggaatgtaactgccaaggtgatggtattaagagggaggtactttggggaagtgattaagtcaccagcactcaaccctcatgaatgggactagtgctcttataaaagaggtcaaagggagcagcctagtccctttggctctttcccttccaccatctgagaacacagcattagtctcttcctccatgtgaagaagacatggcaagaaggcaccatcttgcaagcagagatcaagtgtgtaacagacatcaaatctaattagcaccttgacctaggacttcccagcctccagaactgtgagaaataaatttgattatttataaattaattagtttgtggtattttgttacagtaacaaaaatggactaagacattgctagagtactctgggttgtattcatgcctttgaaagagcatcactatgattgttcaatactctataatgataataataacaacaatctcctgcctttgtgttcatccattcatgtgttgaacgtataggttctcagtctcatacagtatttctacatagaacatacagaaacattccagtttctgtatttgcttatcaacactgatctaatggtcatttcccaaaaggagccctacccagcaatgaggaattcagatcaggctcagagtagggcttaacactttcttagacaattaattactaaaatgactaacagtgtttccctgaatgagaactaccttatctgaaagacttaggtgtgtcaaatacatgtggccaagttaccaaaggaaaacaaccgctattttatttggttaattgatttagtaatttcattgactcatgaaggaaaacactatataatgagataagaataaaaggaaattacccctacataagggacccaatacttgctttcatcctttctattctctctcctcaccaaagtgaaatatacttactaaaagtttaaaatattatttctaggcccactaaaatcagaatctacagagaccgaatctaccccaagtgggacagacatgacttatggcctgtctaaatgccaagtgttcaggtatgccagtaggacccttctcccgccctagggataagtcattattggtgtaaatcaatctctgtaacaccattcctctttgccacttattggctaaggagtgagcatgattcatttcttgccattggaatttgtaggcaagactattggggcatattacataagattttccttcttaataaagacagagagagaggaggaaaatcctctcctctttttgtctttaaatgaccaggtaaagaggcaagggaagttgggattgtggatgggtttcttgggacaattctagcagccatcattcacccatgaagaaaagtcaagattagctgaacacagaaagcaacatagagccctgatattactgagctactgaacaaaccctggacccacctaccttcaaacatcttcatgtatgagcaaagtacatctgtatttttgaagggagttttggctgaatatcctgttacttgcagccaaaagcatcctaaccaatataacaggtgattttgttgcagaaccatccctgagaagccctgatgaacagcagtgatgaggaacctctgtcttacaaactttagtttctatctttctagcttcttgttacagtgcaaaatcatcatagacaatgaatgatcagaacactgcctttgtattgaaatttctcaaaaatgtccagaaaataacattttataaagttaaaaattagtgccaaggttttcactgccattcttttagtcaacagaaattatttggattgtaagattatgtatttcccctcctctaccctgaagttaaattgtaatatttgaatactgaatgaagaaaagttggacttataaacgtttggttgttttccaaatttccactcatgaaacaaaacaacaacaataaaatatcactactattgctgcctggagtttcatttctgctttttctacttgaagaaattcaaaatctaactcaaatgtcaccttctcagtatttcctaactccaacattgacaaactgtctccctcgttttcctctctgatgattcattcattcattcaacaaacaagagctattaagctcttgttacgtcccagtccttgagctgaggattcagaagtgaacggtcttaaatagttcctatattcagatcttgtaatctagttacaggatgataaaggatgataaatgattcctaagcaatcacaatgaaatatggttaagtttcaactttagacacataacaaccccatcccttaacaagtttcatttccttttttttcttttctgagatggagtcttgctctgtcacctaggctggagtgcagtggcacaatcttggctcactgcaacctgtgcctcctgggttcaagcgattcttcagcctcagcctccggaatagctggaattacgggcgtgcaccaccatgcccagctaatttttatatttttagtagagatggggttttaccatgttggctaggctggtctcgaactcctgacctcaggtgatatgcccacctcggcctcacaaagccttaacaagtttctctggtgtgataggcacaagagtaacaaagatgactaagatgcagtctgccctttaagggatggtcagagactgatatgtgtttaccaaaatcgtttactcttctgcctgggtccatagtacatttccagtctcccttgcaggtcagtgtggcatgtgactgaagtctggtcaatggcatgtggacataaatagtatgtgatttccagtcctcacccataagaaacaatcctcatgcaatcctctagtagcttttctttttctgtccgttgcctggaaactaaggactccaaggtcttaggggatagcaaagccataatataaaaggagtttgggttcctgaataattgagtagaaggccaacagctgaacacgtgaatggacttgacatgaacgagaaataagcctgaactatgtttagttactgagatgttttactttatctcttacagcagctactgctgtcttaaggttatattcttcagtcaatagcatacgatgattcttagcacctcgaggatgctaacccagtccacaaaggcaacaccccctctggttaatctgagaactaaaataaaagcaagcaagaaaacccacgccaacaccttacaacagtaaacagacacgcgcccgtcaccgggtgtacaaacagaaaaggctgggcccctcgctcgcgtctccggtccagcaggcctacagggtacccgccgctggcgctgggtttatttttacccttagtgtctctggggcctctcacctggcagtctccggcgaagtcgaccaggctccgtctgaacgattaggaaaggggctgtgggggaggcggcggagcccggtctagccaccgcgctctggggttcccgattcgcgcatcttcccaggctgagccgggaggctgcgttgactgcagataaacggtctcagggcgcggcaccgcgtgtagtcggccccgcctttcgcacgaacccgctgggcgacaccgcgcagggaggtccgacccgtcggcgccggtacaggctccggagtaagcatgggttggtccggggcccgcagcggcagccccgtgtgccctccgccgggtttcaggtccggcggcgcgggtgcagagccgcgtgcgatgcctggtgcgcgtggcttcccccggaaaggtggcgccaggccgaccatgggcccacgtcccggggcctcggagcggcaccgcgcggtctttcagctgcttatcctccctgggcgggtccgcaggcttctggggccaggaccagcgagctcccgggaaagcttcccggaaagcttacccagagagcgcggacccaggcgccgagtcttcccggagatgacgagacaccgcgagaggagcacagcgcaggctcctcgggactccgcggcgcaggccgggcagcccgttacttgttttatcgttcccgaaaccaacctctaagttgtctatcagtcctccaccttttagctgtacctcttagaagtgtcttctcagctgcggtgggaagataggattctttcttaaggtgaccaattaaatggccggataaaagacttgttctgcccccctttatcgcttaacacctgccc

SEQ ID NO: 494 - DNA, 118813 bp, Homo sapiens
attccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggc

SEQ ID NO: 495 - DNA, 134705 bp, Homo sapiens
tctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaaattttcagatttcctgtaatttttccattactatccctcataaatttctctgcatgatcacactaaagatataaattaatcacatccattcaacaaattaagaaactcaaaactcacaagtacaatcttcaaccctatagaatgctaccaagaagtaaaataagatgaaggtagaaagattctctttgagggccaggtgcggtggctcacacctgtaattaattccagcactttgggaggccaaggcgggcagatcgcctaaggtcaggagttcaagaccagcctggccaacatcgtgaaaactcgtctctacaaaaatataaaaattagctgggcatgatggcggatgcctgtaatcccagctactcgggaggctgaggtggaagaatcgcttgaatccaggaggcagaggttgcagtgcgccaaggttgtgccattgcattccagcctgggccacagagcaagactccatctcaaaaaaaaaaaaaaaaaaaaaaaagaaaaagaaaaaagaaagattcactttgaaatgctgcatgcaactatttagcaacacattggaaaatctagagaaaatgggtaattttctggaaaaatataaatgaccaaaactaatccaagaagaaatttaaaatgttaatagaccagttacaaagaagagaatgtaaagtgattttttaaaatccataatttaaaaagtactagggttgcaagaaggataattccaatgttatttaaagtatcccaaattttttttaaaaagaaaaaccaattcatttcacataggcagtgcagcattaatatgaaaacctgataaacataagacaaaactgtaggccaggtgcagtggcttacacctgtaatcccagcactttgggaagccaaggtgggtggatcacttaaggtcaggagttcaagaccagcctggacaatatggcgaaaccccatctctactaaaaatacaaaaattagcctggcatggtggtgcatgcctgtaatcccagcttgaacccaggaggcagaggttgcagtgagccgagatcacgccactgcactccagcctgggtgacagagcaagtctccatctcaaaacaaaaaaacaaacaaaaaaaccaaaactatagaccaatctgacatacatatgaatgaatattctaaataaaaacccagcactgttatcaataattgcaacaacaaaaaagagtaatacagtatgcaaagagcactgtatttcaggaattcatgggtatttcaatatcagttaagtatattaacacaattacataaatgacatcaaagaagagaaaaatgtgattatatcaataaatgctgagagggctattgttaagattaaacatccactcctaatgaagattcttgagtaaaatagaaattgaaggaaagtgtctaaacataaccgttatttatgaaacgcctacaaaacaagtattttaaatcatgaaacaacgtttcaattaaaacaaggaaccagtaggaatagctgctgtcattatttgttattaaagattatcttggaggatccatgaatgtaacaagatttttaaatgaaataatcagtataaatatatagaaaactttttgtggatatgattatatgcctaggaaatcatagagattaggaaaaacagaaatttcaaatattttaaagaggaatattggtaagttatttggaaataagatgataatacaaaatatattagcaataagcaccttgaaatgctagtggtaaaaatattcacaataacaaaaataataaaggtaaaataaatttaccaagaaaggtagaagatctataagaaaaaaactataaaaatgttaccaaaagctactgaataagaaacacatgaggctaggcgcagtggctcatacctgtaatctcagcactttgggaggctgaggcaggaggactgcttgagcccaggagttcaaaaccagcttgggcaaattgtgaaacgctatctctaaccaaaacaaaaagctagttgggcttggcgcatgcttatagaaccaggtacttgggaggctgaggtgggaggttggggcttcagtgagctgagatcccaccactgcactccagcctgggtgacaaagtaagaccctgtctcaaaaaaacaaacaaaactcttgtaaaaacataaatctaaaattatatataaattcaattaaattcacattagaatcacaaaagcattttaaaattggattaaattatcttaaagttcatgtagaagaatagtcagaaaattgttccaaaaaaaagactattgagaggaacttttctcagcagatatcagcacctactatagaactattggaattgatcaattaagaaaaacaattgtattaagaataagcaagagtggtaaaaaattgagaatctacatgtagatgaaaaattaatatatgaaaataaacaattcaaagaaaacaaaattggaccctcaatttacactgaaggctttgaagtgacacataaaatgattttttaaatgatttaaatacgtacataaatggagacaggaagggtgggagagaagcagaagagaaagaaaatagaagactaaagaacaggaacacctatgtggaaaaaggtaacacttaatgacaaaatatgttttatgtgaatatcagttatacataataaatattggggacattgccttgtgggttataataaagcattaagaaacagagtagtgaacaaaaaaaggaaagaaaactaccaaattccatgtatgataccccattttaaaattacataaattaaatgtgtacacataagaaaattttaaacattaaaattttgttaataaaacagatttgataacacgaaggccaatgatgaccttacccacagcagttttgtttaaatggggactaaggatggagcaaaatttttagtagagcactttgaataatgaattagcaaactataataaactgaaatcttacctaccaaataatctcagtaaacaaatctaaaagaaatgagtaaaacaattgtgagcaaaaaaggatagagtcactacatataatgtaaatgagacaaggatggcctctgtgtattggtgcctaggttatttcttcacagcaagctgagacccattagctcaaaagccaactggcagcaaactcaaatttttaaacatccaattgtgttaaacattgcccagacatgcagatttgtaggcatttagagcctgcctgatttacatgccctgggaaactgtgtccaaaatctgcctgccacagataaaccctaggctgtaaagaccccaggctgcttctgctctttggaactctgtgaactatagactccatgccatgctgctgagtgatatcactgagacatgaaagcctcctctctgatcctttcctccctcaggagttcctttgccctcctccccttctgagtggtggcccccttgcctcaatcctctggtccatctcttgctgtgaaggccttccccaggatacaaacctgacgagatcatccagataaagcccatgtgtgcttctgtcacatctttttctatatttttctcacttttttctaaacttttctaattttttcttaatttttataaaattgtggatacctaataatgtagtctcaaaataaataaagccaaaattagaactggaaagagcaataaaaaaatccacaaacatagtgagagattttaacaattcatttttagtaattgaaaaaataaacactgcacaaacttcccgaggctccaccccgtaatcccagtgcacaggtgggcattattcagaatcagtggggaaagggcggcttcaaccaggacccgcagtccagtttatctaacagccttcaggctgttttagtcttgaaggtggggttttaccgggggacccttggttgcctcctgtctctatcactttcacattaggtgctttgtggtgaaaatggtttcaagggtgatggcattgtacatattgagacacagaagcagctgaaagttctattaaaaaatgaaatggatgcttctaaatgacagcaaagtctttgttggattaagtcttgtaaacaatgagaagcagaactcagagttaaaaagttcaccaatgtttacaggaagatttttggagaagacatggatggtaggtgccttaaagatctctttggcaagttgggatctgtcttaagtgtgaaagtagtggttaatgaaagtggaaaacccaaaggttttggatttgtcagctttgaaaggcataaagatgcgcagatgagatgaacagaaagaagctcaatggaaaacaaattgatgttggtcaagctcagaaagaagtagaatggcagatggaacttgtgtgcaaatttgaaaagatcaagcagtataggatcaccagataacaaagtgttaacatttatgcaaaaaatcttgatggtattgatgaatgtctctggaaagaactttctccacttggtacaatcactaatgcaaaggttatgaaggatggttgtcacaacaaagggtttgatttgtgtatgtttctcctctccagaggaagcaactaaagcactttcagaaatgaatggtagaattgtgggcactgagccattgtatatagcattaactccatgggaagaagagcaatgaagagcaccaggctcagctcattaaccagtacagtatgtgcaaagaatggcaagtgtaaaaactatgctcaacctgggaatcagcctctatcagccagcaccttcttcaatttacttcatggtagttatcccacagactgacagccatgctgcaaagtattctcctagccaaactgctcaactaagatcaaatcctccctaaattgctcagggtgccagacctcatccattgaaaaatatgcccaagccactcctagctcactacatttagtagtaagagaccagcttcttcacagcttccacgagtcatgtcaacacagctgttgtaacacatcaacacagacaataggagcacattctgcagttgccgctactgctactacagatactcctgctgtttgcaccatttcacagtataaatatgctatggaagttcacaatcctcaatggcagtttcatgcacagccccaagttaccgtgcagcagcctgctgttcatgtagaaggtcaagaacctttgacttccatgatggcatctgctcctcctcaaaagcaaaagcaaacgagtgaatggctctttcctcttcttcaagccatgccctagtcgtgctggtaaaatcattggcatgttgttggagattggttatttagaacttcttcatatgcttgaatctccagagcctcgctgtactaaggttgacaaaggtatagctgtaccacaagaccaccaagctaaagaggctgcccagaaagcagttaatggtgccactggtgttccaattatttaaaactgatcagggaccacagaaagaaacttgcgcatcactgaagaaaaaatctcaatatcaaaaaccttaaatactatggaaaaaatttgtaaagtataaaataaatttaaaaaggaaactttgaactttacataccaagcaaacgtcagatctaacaaatgcaatgatagtcctagattacttactgatttgaaaacaaaaaatcctcccaaaataataaaatataaaaatgctgcaatgcttttcagactctgtgataaataattttcagcaaagtataaaaatttaaagcattcctttaattttgtaattcgttagtgtggaatagctcagaatgtcacttctgttttaagtaacagaattgataactgagcaaggaaaggtaatttggattataaaattttgctttaataaaaattccttaaacagtgaaaaaaataggcaaagatacaaaaagttgataagaaacaacaatcttgtatttatttgttattttatttttttgagacggagtctcgctctgtcacccaggccggagtgcagtggcgtgatcttggctcactgcaacctttgcctcccaggttcaagtgattctcctgcctcagcctcccgagtagccgggactacaggcacctgccaccacgcctggctagttttttgtatttttattttttttgttatttgtatttttgtatttcaccatgttagccaggatggtctccctcccctgacctcatgatccacccgccttggcctcccaaagtgctgggatggtgtgagccactgtgcccagccttatttgtttaaatactataaacactaatatcatacacatggttaactggttgtaatttttaaattatattaataaatttttataaaaactttttataaataaaaaacttaaaatttcaaataaataacaacatctgccacaccaccttaaaagggcgactatttcagtataataaacatatatcacagacacttagagaaagttcaataaataaagaataaaaagaatagttacaacaattttcctcctaatcaataacacaattcctcattttgaaaattatttatctctcttttattaaaataaactttctactttgaaatctaatcctcttgtgaatgtaaaatactatcttgtaaatatatatatatatattttattattattattttttgagacagagtcttgctctgtctcccaggctggagtgcagtggtgcgatctcagctcactgcaacctctgcctcctgggttcaagcgattctcctgccttagccttctgagtagctgggattacaggtgtgcgccaccacacctgacaaatttttgtatttttagtagagacggggtttcaccatgttggtcaggttggtctcgaactcctgacctcgtgatctgcccatgtcggcctcccaaagtgctgggattacaggcatgagccacaacaccctgcttatatttttattttcttgtaagtgacaatgagatgccctcatgatttaaatagtagtcaaaacactggcacagtttaaatttttagaatttgagtactagaattacaatatttgaaaatggagtctgtactttgttgtaaaactataaggagaaaatgtcactaaaatagtagctattttatcttttcccagagttattctcccagagtgtattttctaagagttatttcccagaaggttttagaacttctggcagtttcggtgatatattctgtaaaagcccttagtcttaataggaataacacatagttttgattgccttaaattttaattgcttcacttggcaaatttatgtgtaaatgtcatattctgtggtattttaataccttgcttgtggagaagaggaaaaagaggaatgaaagtaatattcagtccttgcattgagcttttgccaaagaagtctaaacaatttctaagatgccattcaataaggccattttagaatcgtttatatgactcttataactttaaaataaagagtcttgaagttaattaaaactcactttgcttgtgatgggttctacattaacatggcagatttaatcagccagaattaaaaggtaattctatattactaaggagaagaaactgccacatgacagcagtctccaaatctttcatttttggaggctgccttttatgcctagattttaaaatactaattgaaaaaaatatagtttacttccatttgtgatttaattttatttctataaataaaaatatagatagtgtttcatctaaaaactgctaaaccagactttcattttaagggcatggcagaagtaaggaaagactaacttggttctattactgaacatattatttactcaggtagtcaccaaaaccagaatttaaaatctatttagttaacccatttaaagttgatgtgttttattccttttctttctttttgtggtgatctttttaactgaattactggacatcatgggagttctactccttctatttggaaacttaggctatcttaccaagttcaatattcaaagtttttctttctgccattaagtttgtttaattttatattaagctcagtttgtattatgatatcaaattcagcctgagggattactttaaactttcctagggtatttacagatttaatttgttcttacagtatgtaaataccaagagagcattccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggc

SEQ ID NO: 496 - DNA, 134705 bp, Homo sapiens; identical to SEQ ID NO: 495

SEQ ID NO: 497 - DNA, 134705 bp, Homo sapiens; identical to SEQ ID NO: 495

SEQ ID NO: 498 - DNA, 23838 bp, Homo sapiens
caggccgaggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacaggtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcaatgaaaatattttatcttttctacagttaagaaatagaaataatttctgtgtttagctacatatgataaatgagaaaatatgttataaaataaccagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagaagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcttcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgagccactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaagggatgtaaaagtcaatatgaatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactgtatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcaatttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatccgcctgcctcagcctcccaaagtgctaggattacaggcatgagccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagaaaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcactccagcctgggtgacagagtgagactatctcattaaaaaaaaaaaatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaatttttttttgcacattatttacagttagtaatattttcctttcaaagtatctaaaatatctgtaatagctgaacatatatcaaacagatctatagagactagcacatgtaaaattttttttaagtttcttgtttgattcttctgtatttcatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagaggaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaactgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggactttgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatacccttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatgtatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaa

SEQ ID NO: 499 - DNA, 22244 bp, Homo sapiens
gtgcatttatttaaaatttatttgttcatagctatacatatattatacatgtatacctgctcacagcataaagtatttcatgacatacttgtaagagtcagtgttctatgaattcactagagaagttacagcattttgattatgatacacgaaaagaaacccaagtcatttagcttaactccttaatttcataaaccagaaaactaaaatccaagatagattgggtgacttggtctagatcacaaaccaaagttagccataattcggtagtgtagtgcccggtccaaaacctcatagataatcttataatcaatggactctttctgaatgctagtcaaaatgtccttttgtgtgaattttaatgtaccgtcatcaactgcatgatattcttccccatacacaaagtgttatctttttgttgtccatttcagaattttccatgttaatattaaagttctaggaaaaaaggctaagaatcactgcacatttattgagtatctcagtgtgcatcataccatttggtcatttgaggttgcaacaagtaaaaaacaaacataaaacccttaaattaaaataaaaacaaaaaactttgccctgacaatgttacagaattaacatccataaatttacttttcttgaaaaatttattttctttaatttcgtttgtttcctgttacataatttatatttaaatttacatttatttatccagaaactatgtccaaattttatgtcctcttttctgttatcctggagtttggtgaagaaatctgtacttaatttagaaaagaaatccctctaactgacaatattgttagctaactatatatttcttaggcccatgtcaaatatcattgcttattttaataaagattgtttagttagactaagaaaatagtaaataataagggatggcatccgttaagtataaacactggattatttttcataacataacaggtcaacaatatcgttttgaggctgaactcctttactccttttactgtaagctattgaagccaaactccttcctacctttgttcatttatgatggtgtaaaattttaaaattaggatctacatacagaacaatgcagaattatataaaaatatttgaatattgaaaaatgaagtggaaattattattattatttaggtacagggtcttgctctgtcaccctggagtgcagtggcatgattacagctcactgcagcctcaaactcttgggctcaagtaatcctcctgccttagcctctgttaaccatgctggtcctgaactcctggccgcaagtgatcctcctgccttggcctcccaaagtgcaggaattataggcatgagctaccatgcctagtcctgaaattactatcttcttccttaacccccatctcccccacaaaaaaacaaaaacttccttttttcttcatatttacattttaattgtatatgctgcaatggcctatttgtatcaccccagagtcatgtgttgacatcctaacctgcaatatgatacattaggaggtggggcctttgggaggtaatcaggtcataagggtagtgccctcatgaacaggattagtgtccttataaaaagacacatgagcgctcgctttttttctctgctcttgctatgtgaggatacagcaagaagaggaccatctgcaaaccaggaagtgggccctaaccagaaactatatctgctggcacctttatcttgcacttcctagcctccagactgaaaaataaatgtttgttgtctatgacactccatctatggtaatttgttatagcagcccaaagtgactaagacagatgctaacaaatcgagatttattttaaaaactattctcctgctatgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagactgcagtgataaacacaaggagacagaacaattaaccaggtttgatacaggctgtattttgaaattttcctgtgactaggataactaaacaatttacccttgtcctaacaggaaacctcacttaaacacttaattcagggaaatccaaattaacatttggttgatttagaactgctgagtgtcctgtgatctggaactaaatggcctctggctggtgtctaagcacctgtcactgttaggtatttggtctcagaatccccaaattaaggaacagtgatgtatagccattccccaaattaggatataggctaaaagcacattttcattttgaaactcagaactattcaaaactagctaagttttatgccactaataaacttttgaacataagtgtatcagtcataaaatggtcatattaatgaccagttttttaaaaaagacagcatatatttagttgatcaattataagtggataattgtaggagctgaagcacactaaatgtgttttaaaaatttacatgaatgataataactataatccattaagctataaaaatattctatattagtttcagatatccaaatctttataaaactaaggaatttaaaaaataattactggtttattcccataaatttttcattttctaaataaggctgaagtgatctttttggtagaagtttaaaaatcttttaacttaaaatggataataaagactcaaacagtctaaattcatctgaagcctgaaacaatggaagaggaagtaaggatatcataatgaatagagaaattttaagagttcaatagataaaagctgataatatacagtaggtgaactagggagttattagtcacttcaccaaagaaatacctccaactcccccaagttcttttaaaagacaagctctgttacacatatgaactcctctggaaacctctaaaaagccaaaggtacttttgtagcacatttcaagccacaacacttccaaatatcttgtaacctaagctctggctaactaagggtaatttagcttatcagcagtacccaaatcaaatgagctattctgaagatacggattcagagaaatcacaaaggctcatgtgcttcttcattaaacatttgtctattaatttccccagctattaacaattgttgttaatagttgggagaagttctgagaagaaactgcgctgtcacggaaacatttcaatccctgtatttgtcacattcaccaactatctggtgtgcaccaagttactgggaagaggagctatcagttgttccctcctcgctcccgcctagtcccctttccttccctcttctcacacattacagttccttgttcctgtagtattcagagacataaaacagaggaggaccttcttgtgctctataccttataagcatcatttttgctttcatcttaagccatttaaaagtaaacaatagttattaaggaaaaaactgttaaacagatgcaaagtggaagagattaaattaggaatttccatacacgatgatgaacaagtaagaatttttaaaaatatttatttattttgagacggagtctcactctgtcacccaggctggagtgcagtggcgcaatcccggctcactgcaacctccgcctccctggttcaagcgattctcctgcctcagcctcccgagtagctgggactacaggcgcccgccaccacgctcagctattttctgtttttagtagagacgaggtttcaccatgttggtcaggctggtctcaaactcctgaactcaggtgatccgcctgcctcgacctcccaaagtgctgggattacaggcatgagccaccatgcccggccacaagtaagaattaatagagaaaaaagagccagtggaattctcccaaacaagtcacaagtaaaactaaaacaccacatgcgaattctgtgtccactgaacacaaatctgcttaatcctctccccatttcacttagagctcttataatcctggaggttcaattttttgacttgcatttaatcagggtttccccaattataatttttgaaaggaactgtctctcagaaaattgagcactttaacttttttagtcctccattttgtttgctacaagattttatgtaaagctgaataaggaagaattagtggctcagatcgaagtggtctttctttgagcaaattaaatgagaacttatccctatcttataaatgtagcatcttagcacatatatgccacaaactctctaaaatgatattattttgatgagcaaattgtggccaaatgtgattgagggtaatgaactccttgggaagaatagtgcttacttcatcagaagccaaatacacgcagagcatggctatttcttctgcagttgcgaatcttcccgtcttttgtctcttcaggaaatcattccgtgcctgtgaccagagaccataccagacattagtgatggaagcagctgtatgtgctcacctgcatcttgttcaaggagttaaaggcaagagaatccactggcttgctgccttgatgaataatcaactagggttatggtgattcttttgccaaagttactcaaattgtttgtgttatactaaaacccacagatattgtgacacatcagaaagctaatgttaaaggatgagggcattattttttcatcttcaaaagttgtggtaaagtatacagaatataaaatttactatcttaaccattttaagtgtacagttcaatagtgttaggtacattcacactgttgtgccaccatcaccactgtccatctccagaactcttatttttattattattattttttcttagagacagagtcttgctctgttgcccaggctggagtgcagtgttgtgatcatagctcactgttgtacctcaaactcctgggctcaagcgatcccccagcctcagcttcccaagcagaactcttttcatcttacaaaatggaacctctctactcattaagcattaactactcttttccctccttccaagcccctggcaactaccatttcactttctgtctctatgaatttgtctgctataggtatggaagagggcatttattaacaaaaggtttaaatacattttaaatgctagatgtacctcttcaggatttcctctggcttgtattctttcttgtagagatggcgtatcaactgttcctaaatcaaagggggatattcagcttggttactcactttcactgaaaaagaaatcgataactaaacttcctttccatatgacaatcagtgagattcttctccttgacttaaaatgacaactttacagctgcctgcctgaggcctcttatttaataggcttataatttcttcaataacatttctatgattttaaaaacacagactatgattcttcgtgacactatgtagggactctggatgaatcacccagcattctcaaggacatatattttagtcacattgcatttatatgatgctttatggattttaaatacatttatgcatatgatctcagctaatcctcacaataaccctgagatgtagataaaatcgtacaagcactttgccagcttaaggagccagtttgcctcaatgatctcaaaaccattctttgctgtcaagttcactgtggcatctttggggacaatcccatggctaccatagtccttggtaattcaggtggcgctaaatttttcttatcaccttgcctattttcattgtttcaaatgcctacttttaaccacagtttcaagtttttaatcaaaaatataatttaatctaatttaaagttattttactttaaaaaagaaaaataagaacaacgctaacattttaaaattccacttagtttatggtctcctagagcacgttacccagacttttttgttaacggacataaactgttcattctctttagagggccctttttcagactaaagagtactctggcaaataatgtgatctttctgaggttgtaacaaatggttttacagtcatacttcacccttagatcatgttcctgagagtgccatagatttgatctttattcagaaaacatttcttaattttagcatcatttgctatttttttctgatgaagctggaaatcttcaaaatcagaaagcctgactccattttggaaccccctctttaggttggttatctgtctcttgtcacattttactataagcagccagcactttcaagactctgggtagaaatcaccttaattagatcacccagttcattaggaacatcttctaccttcacactacaggcaacagtgttgatgtactttctgaaactgtatgacaaagacactcttttttctaattttcaataatattttcctcactttcctcaatagcctccttaaagtccacagttttaccaacagtgtgcacctcaagctttcactaacactccttcagaatcttacagctttaatagctttctccctctgaggtaaatgaacatcatatcttacatatgactggtactaatggctattaaataagaactgtagagcaagcccatgcctttagagtattccaatgtcactgggttcagctgtgtccatggcacagacatactatgccagggtctacacaagtctggctggagatttgtgactatacaaccatcagcagcatctcagacatactcagtcctcctcaagttttcttctgtgattggttcactgagtcacagctagttccttgttccaaagagtttgataacatattttccaatctcctgataagtccagtcgctgaaacaaccacattttccaaatcattttaccacttattccactgggtaaatggcaccaagaatagctagactcaagtatcgccaggatgtacattaaaacccaatgaaatgacctctcatgcattcttctttttcttagcgttacctacgtttacatttctgttccaagaaaaataaaacagaacatctcaatcgctgaaattctgtagcttgggggatgtttagtttcccctctttaagtcagtgggtttcaactgaagattcaatcagaatctcttgtgggtctttctaaaccacacaattctctccatgaactccttccctaaattctggcatgcccttcaggtttgaaaggtccccaggtcatattgaaatgtttccctttcacacaccaccccccattatcaattgtgcactaccaagggaaaccttgatcctggatatgcaatcatttctttttaaagaatattataatccttattagataccttaagttccttttagattggtagaaccaggtaaaagtacatatcaatttaataaacacatctacggttattgtgaaaatgagacacacccctatagttattaagaaaaggaaagttctgcttttcttctttgctttgtatgagggatcggcacacctttcttggtaaagaggcagacaaaaaatatttatggctttgagagtcattttatctgttgcaactattatactaaactctgcctttgtagcatgaaaacagccataggcaataacataagcaaattgggtgtggaagtgtttcagtaaaactttgcttacaaaacaggtgtgccttactcacctgggcacacacagttgcacctgatgccctgctggatgaaatctgcagccacagattttgtgaggccaatcacggctgccttggttgtgctgtacacacatctgttcacaactcctgagggtggaggaaaggttcaacaattgaaggaataaaaaatgtattttccttcagaaaggtaacacaaataagttttcccagtagccattttcatgctttctcccacattcctccccttttaaaaagattgatatcagatttttttccttcaatagagtcagtttctggatctagggaaataatatcagtataggcacaacttaattgagacttaattgaaatgctgaacttacttaacattggtagtcttagtttctcatcatcagttgccataactcttaggcagattccaaaagaaaatgaagattaataacaaaacaaaacaataaaacaggaggcctaggcacttctttacattcctctcttgtgtatgttgaatatgtgtatccttgcaaagagaagaaatggtatctcagcagtaactatttcattttaaactcacagatccaactatgccagattgtgacataatccacattttgtactgctgtccttgtccttcaacttgacttcttgctgatggctcagatcaactgtctttgtgaagcattccacaaactcacaggcagttatttccctgtattttgacagcgctttgtacaaacctctgttatatatcatcacactggagaagatgatgtttgctgccttgctcctagttttggactgtgaattcttttatggccagagcacataccggtgctcaatacactattttaaattaattaaatgttaaatggttctttctcccagtttgatgttcatttccatgtccattagaaagaataaaagggagggcaaaaataccccacattttaatttaattttaccactggctcacatcgagagcaaaagatctgtggttaaggaacttaataccaattttgaaaaaagcagttttgaaatcatttcaatacttgaaattataatctctgctatgcctgttcccaaacgcagagctcttaatgatgtgcgtgtatgagcatcgcagtcctcggaaggagacagacccacctttgacgctggaagccacagaagacatgttgataatattgccagatttctgagcaagcatctgccaaaacaaaacaaatacaaaaaaaaaaaaatccactttgtgggctaaaatactaccttttaaaaagatttgcattttcttagggtttgcagaatgaatttaattactgtattagctagtcacattaagcactattaagcagtcttaacagtgaacccaaaacacctcatcaactattgctgggaaatgatggcaatgtgactgcactcactggcatttcccagggggattaccaccttcccatggtacaagaatgtcagcaagactacgagtgaatgctgacttaaatgaaatgtgaataaatgttgttattgtgtgttactgatgttgggaaacttactccattcaacacataatttttgaatacctactgaggccaggtattgtgctaggtccaggagattactgcctacaggaggcaaccagtctggttagagtggctcacataatccacatccagccacagcagagacctccacagagatctaacagcagggtgagggcagaaagggagcaattcaggctgggcgacactcagaggggacctcctgagaaggaaggatatgggctgaattttgaacactagagtattagtcagaaaaataaaagaaaaggatgttttgaggagtgggtacacaggtataaaggttccatcgggaactgggaggaggggctgggtctggctggaatgcagggtgtggaagcaatgaggctgcagaggtcaacaagggctgaatttagaacctgggttttaccctgaaggtgatgcagtgacactgaagggtttaaagcagagaagtggcatgttcagacttggggattgcaaggattactgtggtgcccagagactagtggaagctgatgcaggcttcaggaaagagtgataaaggtggagctgcagaaatgtctatgggtagctgaggaggagagggctgaggcaggatgggcaggaccttgtagatggttgctgcagggatggtgggcctcaccaatttagggcagtgtttcctaagaacaccttcttcagaattcccccactaaagtgtgaatttattaagatgagggtctttggctgttttgtcctcctagacagtgtacacagtaggcagtcaataaatgttgatgaatcagaatctcctgaggtgctagtttaaaacacagattgctgggccctgtcctatagctaaataaatatataataaagaaaactgctatgaatttaaaaatgttttcaaactttactaattataacatgtacatagaagtctcaataggcagtgtaaagggccagagaaaaaaaatgacttctgttgggacgagtttctttagcagcttttagaaaaagaggtgtaggaaaggaaaaagtaaataattgaatggatccaggattggtgtggccaagatgattgatttcttaggatattcttctgactttgttctgagatttagctactaattgcccctaaaaacagaatctaaactaaccccaaggcactatgctgaatggagtaagtggatacaaggagaggctgactgtaacccaaccaagctaaggaagacagcaggggaaaaaataatgtttaacttaattgtgtgttttatataataaagaggatcataatgaaatggggttctcataaaaagtgtcaagaatgttggtcaagtgtaatggtgttgaaaagtaagccttaaaattgttctttcttatccaatttagcaaatagcattccccatttaaaatacatatagaatacatataccccaatttaatacataaagatgggttattatgtaggttcaatctctagtcctctctagaaatgcaatattatctcaggcaaaaccttagaataaagccacctaagagacattacattagtgctgccccctaacacttgcactatccattcaaccaagttcaaccgaggtccctctgctgcttctagagcccctagtcagtacctgttcccatgctgccttcccagtccaggtcaggagctgtcgtcatggtgtcaggctctccctggctccccatgcaatagccttctctggcaggcatgactataaagtcaagtgcctggtacatagtactgctatctaggattgacctcccagaagcttaggtaggggctagaaataccccttaagagtccctggagctgtatctagttagtcttactctgacccagcccttctgtctccattggccagagctcagcccctaaccctggtggaacctggccacttgggtctccagtggttcctgctggactaacaaccttgattcatttatttatttgacaaatgtttgtggagcacctctatacgctgaagactcttctaagacacagcaaggtgggggaaaaaagcaagcaaacaaaccaacccaaataacaaagatatccccaaatctttgccctaatggatcttctcttctggtggagcctggattctgcattgacctcttcttaaagtattttcaacttgttctctgccttttgactgatcttccagtcttggaatgctttcctgtgtatctatccatgaataaaaatttcctatgagtgttcctatgttctgaccagctgaccttccagagctgcctagactccaaatcctagcttcccctggaaagttctaacatgggatatgtgtgtcatagttaatgatacagaggatcatagataattatggctggaagtgattgtgtaacctatcatcctcattttttagctaaaagaaatatgtactgagagggtacaagtgccatctctatggcacatggccaattaggggcagggcgcagactgcacctaaggacttctgatgatagagtccaagaccaggattcgattttgtcaaggtcactttaaacaagaggcactaataccatattcctgccattaacatctcttgggatttttttttaaacaaatctgtgtttttggcccacatggataattgttaagatattgtaaatcacaagcaaactcactagtttgcaagttaatgtttgtatattttaaaaattaacacaagtttacatttcagctccactgtactccacacctacttcctttactaaaatttgtaaagcattttagagcctggttttgcaaatgagtctcatgcatgtgcaacagtcttacccacgatgacctaagctttcctcctataccacagtctctgctctacccctgtaacctatgcaaaggatctgtcttcaaaaatacattcgtgttccaaatactatagtttctcataaactccaaataggctaaaaaatcaacttacattaaaaaaaacaatttgttataaaaatttgctagttcaacattctgtggacccacccaaaaatcccttctaagcactaaacaagtagatttttcaaagtcccttcattactaagtcagtttctctaattttcctgttaatgttcatctggaaccttcttaacattaggttgaatattcagagtagaatatcagccctgctgtgccattaacaaagctcttctcctgcccagacatggacaggacatcaaatccagctgggatggaagggaaaagttgttcttctgcatttcactaggttcaatttacaaccttgagttgagctggctctgtacccagtcaacccctttcattgtctcagcctgcactgtctgctactactggtttataagctcatttgaaatcagggatgtacgctgctcatgtttatactcccctagaacactttatatagtgatttataccaagaggtacttaatgctagtttataaaataaaattttaaacattgatgcgttgtgtgaaggcttgagaattcaaggaggaatgctgtcttgagcacacactgtctctcacctgcccagtaccactgtggttcagatcaaaacaagagcgaagggagaagcttcagggcagagaaaagcaatggggtacatccctcttgagagtgtgagcctagactgaaattcacgaaggggctcaacgtccaggcttcaaatcttggttctaaccatgtgctagttgggtgaccttgagcaagttgtctgaactctcagtttcatcttctgaacaatggatgagataatagtatctacctcatacgatcattccagtctcgtgtgcctccctgctgttacctctgcctggaatcatctcccaaggtacctgaatgatcagctgtctcacttcttggactgctatgccagtttcacctttgcggtggagtccagaggggccgcattgatatcctagcttctttctcttcattatatttaaaaccacgccacatattctatgtctatttgattactaattgtcccatctcacccccaataatggaacctgccttatagaaggcactttgtttagttcacttatgtgtcttctgtgcctagaatggagcctggcatgtggaaagtgcttaataaatattccttgagtggatgagctggaaggttaaatagattaatttatgtgaaatgccttgatataaatgttcaatgcaagttaatcattgtgttagttattatcactcttcagcacatgtgggaatcccttctgtgtgcccagtacagagacctaatgtggtgcttatcctggtggtggtggtggtggtcttactttaggaaggaatgccttgatcatcaggtacatgctgcgcacattgagattcatcgagaagtcccagtctttctcctcacaatccaggacagttccatgatggacaaaactagaagagtgattaaacaatggaagaataactgccattaaaatttttctattccatctgctgattatttttattgtcacttagtgacttagaccactgtctctttcccttatcaagactttaaacaattcatagtatcacttagtatattatattagtaagaatcccaacaacttaagctagaaatgtcatctgaaaacaagatccttgttttccaaacaaaagtatggtcaccgaacataagaagctttatattaattgtgctggaaacatcaatgccattaaaaacaaacaacaaataaaggcgaacagggctaggcatggtagcacacacctgcagcctcagctactttgaaggctgaggcaagaggaccacttgagcccaggagttttaggatgcagtgagctatgatcattccactgccctctagcctggggaaccaagacaaaccctgtttcagaaaaaaaaaagagagagagaaaaaacatctgccctatttgcctatgtgattcctatttcaagagcaacagtgccctcaggtggcacagatttagaattctcaagggaaatcaaaattgcaaggaaaacaagtgtctgaacatctcagagcagcaaagtgatactgctagtgttctaacatactgagagatgttagtttgttgtaagagagacgttaaggcagaacaaaacaaacccgtaaagtagctttcactatttttcaagttacgttttctgagggaagcttccaaaacactggaacccttactgatttggtcctctggacccaaattatgtaattcattataaaatattgttggctgtgacttccatgtaccaaagctctgctatttcagtcagaatgtcagtttcatgacagcaggaaccacatgattatttctacatcccctacatggctgaaaatttaatagatgctcagaaactaactttgctaactatttgtttcatgtttctgggtgtattcttacatgaggatggaagactatttataaaatagatgatcagaaattattgctttaatttaacttccatacattgtaacacataatacagctttgtatcagtaccatctgtcttgagtagacctcatttgccccagatcatgtcaaactctaaggctgtcttacctgctgaattttatgtgtaatgaaaatgctgtgtaaaatctagccatatttcccaaggaatatgtcatggttcacaatgaatgattttgccacattatgaaaattctttgaatgaaagtcatagaaaactttctgtaaggaaagtgaaactaaaaagttatgaattacccagcaacattaaagagaacatcaagtctctcaacttcattggcaaactgatcaatttgtttcttctttgtgacatcaaggacacgagtttgaatacctgaaaaataaaacaagaggcactattcctaaaaatgtttagccttgaaggtttagctgttttgaagtgtgaagtgtgaagattgcaacatctatccagctaggcttcatagattgctgaccttcttactagggtcttaagaatcttcagagtctcattagtaaacttaaagtccatcttgactcctccaataacccatccgtccctcttccttcctctctgtccattttccaagttgaataataagggtcctttctgagcaatggctttatagtaaagaatgactggtgtacattagatgtttctcagtaagccagcagtaataactgaaaatgggctcatttgaagttcttacaaacttcaaacattaattttctcctctttgcagcttttctcttaattttctcttctttgaggtataattgagaaataaaaattgcatatattcaagatgtccttcccctatccttcccctgccagagactgggttgctggtacctatacagtaatcagaattttgtctgagtgaggggtggagaagagcaagtgttctggaataagagactgtttctatttgtgagcttcccctttatgtcatttccattatttattagaaatgactctgttagtcaagggtatccagtcaaatacatgtatttctggactaaactgcaaggagaagaaatgagagggtcagaagaagggatgacacccttgaaggctagacatgagagatctggcatggcgggcacctgagagatacacactgcactagttgctgagaaactccaaacagtgtctaacaaaagcagcagtcatcattataaatatatacacatattatttataatgtgcataatatatattataacatatagtaatataatttataatatatacaatgtattaatatgtatacatataatatataataatatatgaataatacatataatatatagtaatataatttataatatatacaatgtattaatatgtatatgtataatatataataatatatgtataatacatataatatataattatctataatgtgtattatattttataatttataatatattataaataatatgtatatggtttattttgggggaatatagaaataaaagattcataaagaaagggaagacttgaaattttgtttcagaaacatttccttatctttgtgcttccccagtgcagcagctttactttgacttgtttgaattataattcaacatattccaattcaattaactaattcaaggaactaattgctgtttgattatgtaacctgttctattttgctgtaagggttacctttcatataggttctctgttctgatttctttgggtaaactgcaattaaaatcctttggtgttggagtttggttcagtggggtgaagaagtggtggtacacacctaataatctgggtactctcttagggtttctcatgatgatgtgtgattttagagctaagctgtctccagccacatgtggctactgagcacctgaaatgcagctagtctgaaatgaaatgtgctgcaagtgtaaaatacacatgaattttaaagatttagtatgaaaatattgagacgttggtcaaagggtacactcttgcagttataagacttaatatacagtacagtgactatagttattaataatgtattgtatacttgaaatttgctaagagggtagatcctaggtattcttagcacacacatacatacacacagaggtaactaaatgaggtaatggatatgttaattagcttgactgtgataatcatttcacaaggtattttacaacatatatgaaaacatcatgttgaacatcttgaatatatgcaatttttatttctcaattatacctcaaagaagagaaaattaagagaaaagctgcaaagaggagaaaattaatgtttgaagtttgtaagaaacttctaataatttaaataaaaaatttagtaagaaaaaattaaaatattaattttttaacttgagtgcatgttgagattatattttagatatattggataaaagaaaatatattattaaattaattttcacttgattctttttacttttttaatgtggatactagaaaatttaaaattacacaggcagctcacaacatgttactattggacagggctatcctagaggaggagggcacagaagtgaaaagctgtcatgaaaagttaacctaacaactagtaaattttcacatgtaagtttgtaattaggaactgaatccctcaaatgtgttagctaaataaaggattttaagtattcgtcctcaaatttttctatgcatgtaagtcacagatttttgtctataggttcacaaaatatagatttcatatcagagagagaatctaaaaagcacggcagtggagctcagtagctagggaattttctttcaacatgtgagcgccatgctttataataccttgcagacactgaatcccaaattcaagctgctgagttgcttacccgggtacttttccagttcctgaagtttggactcattaatgtctgtggctatgactttggcaccttctcttgcaaaagcctagtagacacaaagtacaaataaatcctttgtttacttgaataaactgtgctcatgaatggaacatcatgtggtctttttctcctttatcttattttcattgttcttttccctataagatagctagaattttaaactatctagtcttaccccttctccattgttattatttttatcattaattagaacaatgtgacatacattgtgcttgtcatctgacttagtccctttaagtaatatcaaacaaaataacgttcttaaaaaaatgacagctgttttcaatactctcaaaatactgctcttctgtaatgagactatatatcatttctgagtttgagttactaaactccaaataataagagaaaaattggttgtttcaacacttttcctactaagagtatgctagtgctttcataaatgtcaaaccataccctgccattatacttaaggtactgttatacttaaggtgccgatattagcttaagtggggtacataatgtaacagaaattgatataaatcaggagaacaaggtaacctgtcttataactctggagtcatatatctaaactgacacaatttcagaaagctgtgtaaccctgtttgccctctgtagcgaatatatcatgatgcagagaaactgaagtagagaagtttctcagagtcaatggttatcagtgatgtcatgtactaaatatgaggtattcattccttcatctgcctggggtcaggagtagggacctatttatttatttgtttatttttataacttaagacaacagaagcacaaaagtaaaaaaataaaaaagcagagcagaagtaaacaaccatggcatcagtccacataattcaatatgtcaagagttagtaggcaaacaacaaagatagtaacttataacttactaaggcagctgcttggccaatcccctgagcagcggccgtcaggatgatgactttcccatcaagtcgacccataatggaacctgtggtttaatctaaagacatgtgtgtttaatgggttatactgtagaacatgatcttgagcaggcagtaacatctagaatgaatagttcagtgtgctcttttaagaataatttagtgagctccttcaggaacttgaagacagcacctctgtgcaagtagtcccatcatctgaattctcctagaatgcttactctgcatacctagctttgtatatcaaacacatttaccataacccactgaagtaatgactggtgacagacattggccattttttttttttttttttttttttatgagatggagtttcactcttgtcacccaggctggagtgtaatggagtgatctcggctcactgcaacctccgccttttaggttcaagcaattctcctgccgcagcctcctgagtagctgggattacaggtgcctgccaccacgcccagccaatttctgtattttttgtagagacgggctttcaccatgttggccagactggtctcaaactcctgacctcaggcaatccacctgcctcagccttccaaagtgctgagattacaggcctgagccactgtgcccagcccagatattgcactttaacctaccttatccttccttcagtacctggagaggacagcctctggtgctgagtttcctcactaccaccatcactctctccatgacccctgcacacattgctatgacattatttgtgtccttactactcagggctgcttcttgatttctcttccataaacttttgttgaggtttgcactatcaattgcttatgattttttttctcttgaaaagatttcatagttggtctcagatattcatcgaaaaaaaaaaggatggaaaaatcaaatcacatccaatactcccattttacagatgaggaaactgctgaaacatgcccaatgtcatagagccagtcaatgggaaagccagaactaaacttagacttccagactcttgctatgtgaacagtccagcccacaatgctgccgatcctcttataaagtttaagcatgcagtagtaacacattaacaggcataatcagtaatttctaaatgattgagaaacactgacaccggggctcatgtgcatgagatatttcaccagtgcttggattatagatcacaaagtgagagaaagagctagtagtgaggctgggggtggagaagagccaaatgaccatcaaatgaggctgtcttcaaggacacaggctccaagtcttgctgggctctgtcattaatgtgtgcctctgacctcatacgaactcacaaagtggctgctttgtccaaggcatcatatccacatttcaggcaaaaagaaagggaggagcaaaagccaaaaggctttcagagaggtctcacctttctatttaagaaggaaaccttctcagaaattcccacctgcagttcattcaccagatctatgctacttggccactcctagctgcaaagaggttggaagttgagacttttgtttccagctttgataaagtgaagaataggagaaagtgagttggatggtgttgatgaaccaacttacagtacatgcaaactagcctacacaatcactctgttccattatctgcctgattttgtacaggttgatagccttgcctaaagggcttatattacctagtcctttctctttgaacttatttcagttctctctttagccaaacttttttttttttatacccaatatgctcttccatttcaaacctccacacttggtccaaggtccacatggtgaagggcaagttactcctataggcaacagccactgaaggatttatggaaagggtgtgaaatgatcagattcgtattttggaaggactgctgtggagaacatacctgggcaggagcatggggtgccattaggaggctgctagggttatctagtgggggcgctggtgaaatagcagggctggagaaaatagcagggatggagagataggtggattggagaagtgtttcagagatgagataggtaggacctgatcaccaacgtggctaatttcaaagaaatgttatttgcccagtgttttgcagctatgaattcaaacctaggccttcttgttgcaggtccaagggaagatctcatggcattgtctcatggtactcaaagccctgcgggcctctctaaatccccactgtggcaccaggagcctgtgcctcgcagaccgctgaccccaggaagtaatggacaatgaggcgcagctgctgctgcctctctgggtttgtgctgaggccaccttctcggggccgttacaagccagtgcctgagcatgcatgcttactaaggcagactcatttctgggagacatagacctcctccccaacggatgactggctagagaagctccttattaccttgctgaagttctcttagactgcacagctgtctgggatgcttccactcaacctggtttccttcttttcctccctcgcgggtggacttgcatcgaggtctgatggctctcacagccttacctagttctctcctcattctctctcacaacagcatttcccctaataaaatccatgcatatttaattctatcttggagtctgcttcttggaggagcagactaacacaattatgtaagaactggctccagggatcagcttataatcactgacttcctctgagtttgtccacattttttaggcgatggggaagcttggctttaacagtgcctgacctactttgatgcaatgaatttttgcttttttacttcttacacaaaagataaacatggaatgtttatcatttcaacatggaatgacagtttctaaagtataactttagaaagatatactttatcctccttgaatcctaagcatggtgcacaaaagctattttacaacactgtcattagtgatattgggtgtatggccctgtaaagcctccagtcaaaggttttgctaggaatctttgccaaccgaagaagcacttccagaacaaatgccgaagcacagagcagcctttctatgcactctgaaaacctcctcttagctggccttcctgtctttctgggaccagattttggggtcaaagccttaacatttgataaactgtaatctcaaactaaaacagatttctttgagaaaatgagagcaaacacggcctgaaatggtaaaacaaggcacctctcaatatatccaatgtgaaaaccatacatgttggcttccttagtccaaaagttagaatcaaaatgttgatttttgattagcagagacacaaacagcatattcaggaagccattgttttcaagagccaggaagaaaactcttcacttaggataccgtaagaatccttttttcttgggctactttataaaacatacataccacagagtttcaggctctttaaaaacccatctttacactgatctaactgctcagattaattttgaaacaggcaacgtgcagaaaaaaacaacatctaaaaattaaacctcccctctttccgttctaaagtttcatttcaaaagtattaggaaatcttactttaagcagcgagctgatggcgttctccagaactcggtttgagcaacaaacttgagacaacctttgtctggaagcaagtcaagcg

SEQ ID NO: 500 - DNA, 110870 bp, Homo sapiens
tattgctaagccatccttcagacagagagggagcggctgcaagaggtaatgaggtatgtttgtgaaccttgtattcttttacggttacagatgtgtgtctacaagtgtgtgtgaatttgagttgatctcttttagtcaaaatgcccttgttggccgggtgcagtggctcacacttgtaatcccagcactttgggaggccgaggcgggtggatcacgagatcaggagatcgagaccatggtgaaaccccatctctactaaaaaaatacaaaaaattagccgggcatggtggcgggcgcctgtagtcccagctactcggagaggctaaggcaggagaatggcgtgaacctgggaggtagagcttgcagtgagccgagatcacgccactgcactccagcctgggtcgtagagcgatactccgtctcaaaaaaaaaaaaaaagcccttgttaatttgttaaacacaaagataaacaacaccaataataaatcaaaaattatgcacatgcatacacatggaacaaaattctcatttatctttttttcttagtgtgtgtatatttttctgaactaaggctggatctataagcctgattgtagtgaaacctgtgtgtttgtgtgtgtttctgtgtgaggtgtgatgaattatttaatacttaggttgaggtagcaggcagaaattctttcagattctggaaatgaagtgagagaaatgaataaaaggagttagaatttgggagtgagattagagcattttccctctgaaaggatttggagttgtgattgagaaaatgtaactgaagaaccaattataatcagaaaattgagaaatatatcactatgcttatgggtttggtgcctctgttgattaaatacagaataattttaggggatagtctgaggatgtgtgtaaaatattgggatgcatttatgagttggtgtgcattggtgggtaggagaggtttcctgtggaatgtgggaggaggtcataaagagaaaggtagggtatctgtcctggcagtcatgtgtggagtagaatgggagtgctcgtgggaagaggagaaggtgataaattgttgttggcccttaaacttaaaaacttaaaataaaatacttaaaataaacttaaaataaaacttaaaataaaacttaaaaaaagttggatccttactagttgccagtctagctagacacacgcaggcatttcttttctgactggttacagaggtgggaagggagagttactcttggggaaagagagagaaattgagactaatccccatgggtctccctgaaaaaggataccactaggttcttcatgcaggatctgatcagtggctttgctgggcgaggaagacctcccaatgtccaaactgtctacagtctgtgtcctggtgtgggacagtaagtgtatgtctgtaggtgtgcaaagagggggtgagatggagggggtctttggtttgttgtgctggtaggtccctgtgctaccagggaccaaatgaagtgggacactaaatttaagacagcttgttgctatttcagtcacactctcacaagatgccaatgattattttttattatcaggcattccctcacaaatacattttaatgagctaataaaattactataaaaattgttctataagcatggaatggaactagaaaagaaattttccatttaaaatttgttcaggtggcagctgtggaatgtgatgagaaatataagcctttgcacaccctgttgctgggctcaaggaggagttagctgtctcctagagatgatccttttgcagttcagatggggaaactgagacccagaggggttaagtggatttttccaaggtcatacagctggctagggtcagagctgactcttaaatctctcaccttgggtgtgaccagacttggaagaaaaaagccattcattagctaccttatcccttcccattcaccaagcagctgggaaaggatggcccaacctactaatatcgcccagcatttttgatgaatagctatggctcactggggtcctctttgcaagttgttcttagtctatctatccacaatgaatcctcttttccactagatctcatgtcttgtgttagcaaaggattttaaaagaatggcttagacctccatatacacatcaaacgctggctataatgccggaaagaggacaaatatccagtttttccaaattaatttagatagccattttaataatttgggcccccatgtggtttgtctactttgcctaaagaactataatggtaccaggacaatgagctttgacaattattcatatactaaataattcaagaagaaaaaaattctattgcttttgcgtaatgtatatatagtaataattctttttttaaattttactttaagttctggaatacatgtgcagaatgtgcaggttcgttacatgggtatacatgcgccatggtggtttgctgcacctgtcaacccatcatctaggttttaagccccacatgcattaggtatttgtcataattctctccctcccctagcccgccatcccctgacaggccctaatgtgtgatgttcccctccccatgtccatgtgttctcattgttcaacttccacttatgagtgaaaacatgtagtgtttggttttctgttcctgtgttagtttgctgagaatgatggcttccagtttcatccatgtccctgcaaaggacatgaactcatccttttttatgactgcatagtatttcatggtgtatatgtgccacattttgtttattcagtctatcattgatgggcatttgggttggttccaagtctttgctattgtaaatagtgctgcagtaaacatacgtgtgcgtgtgtctttatagtagaatgatttataatccttcgggtacataccctgtaatgggattgctgggtcaaatggtatttctagttctagatccttaaggaattgccacgctgtcttccacaatgcttgaactaatttacactcccaacagtgtaaaagcgttcatatgtatatagtaataattcttatatttcagtaagattattttctgaccaacctaattaaaattgccacccttaccccaacattcctcatttaccccccactttttctccatatacttacacagtataacccagtgtatatttatttattttgtttattgtctcttttttctattcatgggaacataagtctcatgacggcagggatttttatctgttttgttcattgttgtgtagtcagtttttgaaagaatgcttggcacattgtaggaacttaataaataattcatgaatgaataaataaactgcaagcagatttctttcttccagagatgtagtttagataatgatgaatgatcttggcaaatgaggcacatcagtagcttcttctaggtctcccagataatttaaaacgtgctatgggccataaacttaatgtgtttttatttgataaaactataatctcacagaaagcccaagctggtgtacactgtggggcattatagcatagaatacagagtgatggttaaaagccatggctgtggagtccaaagggcaggtgttcaaattgtggctttgctccttatcagctgtatgatgacatcaggcagtttatttgacgtttctgaagcttagttttttcatctgaaagtgaggatagtagccatgattaacttgcagtcgttataaaaatggcatgtgacaaattatggaaacctcttaggatatctgctcaatcactgttaaccattattatcattagcattaaaattgcatagttatatatttgtcctataaaaaaatagtcaaagattaaggacagattgccaagtagcagttttttaaaaaacatttttaaaagcccttaaccctatttaaattatttccttttttatttgcgtcttgccatttttcctgatcttagtttttcttcaattgcatttctaattgagataggaagcttcaccatcaagagttctataatgcaggaagtaaggtcaatcagataatgctggagttttttttaaggtttaaggaaatctttctcttgtatagctagaaaatagatattattgttccatagagcaagtaaccatatttgaaaatatggagcaaaaggactattaataaacagcaaacatgtttttaaaaatatgctaatgatattttattaaaaagtcatatttacctatgcatattggttatctattgcagggtaacaaattaccttacaattttgtagtttaaaacaacaaacatttattatctcccaatttatgtaggtcagaaatatgggggtgagttagccgagtggtgctgatttagggtctctcatgaatccagccaatatgtcagccaggactgtagtcatgtgaaggcttgaataggggtagaggcttgctttcaagggacctcactcagatggctcttagcagaagacctcagttctttgctagaaatttccatagtcctgcttgaatgttatgatggcatggtaactggtttcttcaggaaatgatccaagagaaagagcaaggaggaagctgtaatgcctagtcttggaagttagatgccatcccttctccacatcctatctgttgaaagtgagtcactaagtccagctcatcctcagagggtgaggtggtggggactcgccctacctcttgaagagaggagtatcaaataatttgttaaattaaaaacacctgccgtgtgatgattttaaataacattgaattatattttacttcacgtatttactgattgctgtctctatggatatttacacttttttgctattacgtgtaatactgtgatgaaaaacctttatttgtatatacattgattcccaagtgtgtaagtgtatttaagggatgaatttctataaatgcaattgctgggtaatgggcatgagtaattttaatagtttttaccaagtcttcattgagcatagggtgtttatagtttgaccagcagtcggtgggtgtttcttcatagtgtctaacatagtgtgttaataaacacttggaaaaaaattaaatatttttataaaaagcaatctcacatcttacaactattagcatctaccaaagaggaggcatggtcacttggatagacattctaactcctcttcttatcagtgaacataagattactctttgctttattagttaatttaattataccaggcatgagagattattaatctttatggaatttaacaagcaagtttaattttataggatttcttatgaagctctttggaatgtgagatagtggtgacagtcatggtaagaaagactagaattggagtaatttattctagaaaacacaaggcaatccttgctgtagagaaaggttgctttcacagctccatttccttttgcatagtaagagggcattacgttgactaacagcagtttcttatcagtgtatgagaagtaagtcctcttattcaaccaatccttggataaatgactaaggatggctgcttcctactgaagagaatgtgggaggaaacattgattgggtggagaatgagaccgcaaggaaatatcaaacaattcctaaattagggagtcatgaattaagacctcacaggagaagaagggtgatgttctttttgagtaaagagagtatgatttacaaggcagcctgggaaagcaagcattggtgggttggtggagaaagtaggccttgtataggcaagactgtagctatggctcctcttcctggctttctgcacctatgtcccaggcaatgcatgagtcatccaacacacggggccataaagcacttaatgaaggtcataccagagcaagccaaccaggacagcaatcagcattgttcatcagctgctccaccagaacaccaagtcgggtgtggtgacacactcagggaaagtgggactgacatattttgtaggaacattctgtttcttacccaggacccattacctgtcttctctttggtaaataatgagacctgtgctttatgacttagaatatttttatttgatttccacaataagaaggtggcaatagataataataacaaaagaaattgtagtttcattttacagataagaaaattgagactcaagagtattacataaattgtttcagctaccacagcaaaaaatggtatggttgggaatcaagctcagggattctcatgctctatttagcaccaccttctcttctgagaagaacttggggatagaataaaaaaataagacactaatgaaatgtttagcacatgtgtcttttgtgaaagggagaaatagagtagtgtgagatttctgtgactcacttgaaaatgacttttaaaaactaatatagaagccaacatcaccctgataccaaagacaaagacacaacaaaagaataaaactacagaccaatatcccttattaacatagattcaaaaattcttgacaaaatactaacaaactgaatccaacagcatgtggaaaagataataacaccatgattagtgagttttattacagatatgcaaggatgattcaacatgcacaattccataaatgtgattcatcacacaaacagaattaaaaacaaaacccatatgatcatatcaatagatgcacaaaaagtatttgataaaatccagcattccttcataaaaaaaaacccttaaaaaccttggcgtagggagaccatacctcaaaataatgaaagccatatatgaaaaacccatagccaaaatcatactgaacagggaaaagttcagtacgattgaaagcattccccctaaatggagaaaagacaaggatgcccattgtcaccactcatattcaatatagtactgggagtcctagctgcagcagtcaggcaatagaagaaaataacaggcatccaaactggaaaaaaggaagtcaaattacctctgttcactgatggtataatcttatacctaggaaactctaaacccttcaaaagactcctagatttaataaatgacttcagtaaagtttcaggacacaaaattaatgtacaaaaattagtagcatttccatacaccagtaacaatcaggctgagaaccaaatcaagaactcaatcccatttacaataaaataaaataaaatacctagtaatacatttgaccaaggaggtcaaggatctctacagacaactataaaacactgatgaaagaaattgtagatgacacaaattggaaaacatcccatgttcaaggattggaggaatcagtatcatcaaaatgaccatactgcccaaagcaatctacagattcagtgcaattgttatcaaattaccaatattattcttcacaggtttagaaaaaacaatcctaaaattcatatggaaccctgaaagagtgtaagtagcccaagtaatccaaagcaaaaagaataaagctggaggtatcacattacctgacttcaaattactctaaaagactatagtaatgcaaacagcacagtactggtatagaaatagacatataaatcggtagaaaagaatagagaactcagaaacatagccaaatacctacaatcaactgattcttgacaaaaatatgcactggtgaaaggactccctattcaataaatggtactgggaaaactgggatgtcatatgcagaagaatgaaatctctcaccatgtacaaaaattaactcaagatggatttaaggcttaaatgtaagacctgaaactataaaattactagaagaaaaatctaggaaacactctctggacattggcctaggcaaagaatttatgaccaagtcctcaaaagaaaccacaacagaaacaaaatcagacaaaaggggacttaattaaactaaaaagcttctgcacagtaaaaaaataaaatagagtaaacagacaaccaacagaatgggttaaaatatttgcaaacagtgtatctgacaaagggctaagatccagaatctataaggaactcaacaggaaaaaaaacacataaccccattaaaaagtgggcaaaggacatgaacaggtatttttccaaaaaaaaggcatacaagtggccaaaaaacatgaaaaaatgctcaacatcactaatcatcagagaaatgcaaattaaaaccacaaatgagatgatatcttacactggtcagaatggctattattgaaaagtcaaaaaacaacacatattggggaggatgcagaaaaaaggaaatgctgatacagttttagtgaggatgtaaattagtacaatctctatagaaaatggtatggagatttctcaaggaactaaaattagaactacccttcaatccagcaattccactactgagtatctacacataaaaaaataaattgttttatcaagaagacacctgcaattgtatttttattgcagcagtgttcacaatagtaaagtcatgaaatcaatccaagtgttcatcaacagatgattggattaaaaatgtagtgtacctatatgccatggaatactactcatccataaaaaacaatgaaatcatattttttagcaacatggatagacctggaggctattttttctgcgtgaaatgacccagaaacagaaagtaaaaaactgcatgttctcacttatacacgagagataaacagtgagtatatatggacatacagagtcatagacactagagactccaaaaggagaaagggttaggggggaggtgaaatactacctattgggtacaatgtacactatttgggtgattggtacactaaaagcccagtcttcaccactatgcatatacatccatgtaacataattgcatttgtactcctaaatctataaaaattaaaatcagtacaaaatatttttaaaaagtgaaaaaaatgctggtaggaatatcatagatcttctagttcaatttatttcctttgtaaatgagaaaactgagaatgagaaagcttaagtaaattttccaaggtagtctagctggttattttcagaatgaagattgcaaaaaagagaattaactagatttaaagtctcctggaagatgctatatcatctatgtaccattcttgctaaaaaatcaaacttaaatctgataaaaactctaaagctaataattaatttacaggaactataagggtagagaaacatgttagcatgcatagagatgtaatcaacaaaattcagattgcaggaaaaatctacagaacaaattctgtttattaaaaaatacataacagatataaaccaattacaagagataaatcttacttgcatcctcaggagagcagaacaaattataaaagtttatcagacaatgaaagaaattttaaaattcactagatatttgatgacagtaaattattataaacatatattaggtatgataatattttgccttttgcaaaatttcttatcttttaaagaaacatactatttttagattaaaagacatgagacctgagatttgtttcaaagtaattcaggggtagggagaaaagtggaccagaataaggacagaatgaattggccatgagctgataattttttaatttagataatggatgcttgggaggcttgttatagtattcattgcatacatttgagcttttccattaaaaatcttactagttatatagtaaatcaaattcaaatctaaaattgttttctcttacattttagagatggcaagaaagaagctgaaaaaatttactactttggagattgtgctcagtgttcttctgcttgtgttgtttatcatcagtattgttctaattgtgcttttagccaaagagtcactgaaatcaacaggtaagaagtaactctggggctctctccatatgttgtttttattagagcaaaccttcaacaatgtcaggaaagtaatgctttcatgctcatgtgtgtatgtgtttgttgcgggggctgttatatgtgtgtgttctatgtgttttggacagctcagtagatattcattgtaggtttaagttctgatactttgatttatcaattaatgcattgcagaattccataattgactttttaaaaatatttgccaaatttccttaaataagtctaattctgctaagaatgataattaacaatacccttatgtgaaaggcaagcgagtatatgagagacttcaagcagtttgtggaaaaatagaaatatagaaataaaaagaaagctagaaagataaaaataaaaaaaactttatttctcagtgtaaactccatcaagttcaagacacttttgtaaaagatgataccagccatttagtccatccataagaactgagggtcctgggaatttaacctttgtaatgcagtcttttttacattattaactgaaaaaaatgaatgccctttatagatttttttttaagattaggaaactaaaagaagtcaaaaggagccaaataggaaccataaggtggatttcccatcaaaactcttgcaaaattgcccttgtttgatgatgaaattagcaggagctttgtggtggtggagaaggactctccgtgaagctttcccgggcatttttctgctaaagctttggcaaactttctcaaagcactctcatgatgagcagatgttactgctctttggccctccagaaagtcaacaaggaaaatgccttgagtatcccaaaaaaccgttatgtgacctttgctcttgactggtctgcttttgctgtgactgggccactttcccctcttgggagccattgctttgtgctttgtcttaaggctcatactggtaaagccatgttccatcacctgctacaactcttggaagaaatatttcagaatcttgatccccacttgtttaaaatttctgtttaaggttctgctcttgtttgcagctgatgtgggtgcaacaattttggtacccgtagagcagaaagtgtgctcaactttcatttttcagtcagaactatataagctgaaccaattgagacatctgtggttttgactattgtttctggtgttatttgtcagtcctcttcattagggcatgaaaaaattaatttttatcttcacaaatggatgtggatggtctgctgctgtgcgcttcatcttcaatattgtattggcccttcttaaaataagttattcctttgtaaactgctgatttctttggggcattgtccccataaactttttgtgagtatcagtgatttcaccatttttccacccaagcttcaccgtgagtttgatgtttgttcttgtttcaattttagcagaatttatgttgctctgataggtgctcttttcaaattgatgtcttatctttcctagtgcctcaagctaagtcctgttcagacatgttgtaacaatctactttgagtttattttagtaccaaaaatatttgaaatttatacatagttttttcataatacatatttttcatggactttctgaagaccctcatctaatcaaactttttttgtttattgaatttttatatcctcaaaaggagctggattatgctgaattatccatggtttcttatctgattcatctaggatcaacttcctaggagaaccaggcaatcaagtgttaacctgtggcttctctgcccctcctaccccatcccttgttacaacaatatctactttttgtagaaaaaagtcccaaagattgctcaactcttaaaattatgtgattctaaagatgtaactaaaaccattatgcagacattggcacaatttgaatttgaaacccccaatgaaaagaaaaccaatcaaaagacactgttttgtcttaatgtcattattaatttattgcagaataccttcaagaaagctcacctccttattttaggatacaataaaaataccttttctaatttactgatttttaaatctgaattcaaagttcactagcccttaggtaagtcctagctgtcagtttttagagtggtggcctccctttacatcttttgtcatataggactttgtatttacagaagaatggcattgctcagaagcattctttgacttggggattggctgttgactgagcaagcaaagctgaggttactataattaggatgacacttgtactgcacatgttctgtgtgcccttgctgctggggttggaagtaaagaatcagatcagaggtcttcagactttactgtaaaggaccagatagtaaatattttagattttgtgggccatacagactctgccataatgacttaattttgccctagtagcacaaagcagctaaaaacaaacgagtttgtaatgtgtataatatgtaatgtgcatgtgtgtaatgttccagtaatactttgtttgtaaaacaggctttgacttaatttggcctgaaggccatagttactgacccctagactaaaggaagggtggtccccaccttcatgagcttctagtctaaaggcggagtccttgctcttatacatactatcttgtaggggagggagttgggagtagaaggagatgatatagagatacacaaaggtaaatacagtcagcaggaacaaagtgacattttataaagtgaatgcataaattttgaggtcatcagagtgaagcctactcagtagtggagttaattggaggtgttgagaactattgaatgtctgtgaaattaaatttgtctaatggtctttttatgtttgcttttggtatagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggtttgagttatgaattttgtttccattttagaatttatgcaacttgatagtttatttttttttgttgttttgttttggttttctttattagtgactctcaagagaggtgtttatgttgcagccattagtggctcaggcaaattaacctgtgtccatgcttgtatgacagtgcagcttcaggaaaggaagacctggaaaattcccttgggttgccagattcagcaaataaaagtgcggttgcccagccaaattcaaatttcagaaaaacaatgaataagcttttagtataagtgtgtcccgtgaaagattttgggcttacttactaaaaacgtatttgtcttttatatggcaacactacatgattactagttctttctgactctgttcatgccctgtatgtctctcctcctttcagaatttccaaagctcatctagaatctgcagtaaaaattcacaaaacattatttaaaataagggcaaagtttcaagagctctgttttggaaggaagaaggtaatgaataccagattaaagacagtgcagacatctgggcatttaccttagcccagtgtttctagattatcggctgaagtccacctgattatgatgattataaagtacttgcccacaccctatgtttgatgtgccaaatttacagaaagttgatgcacatgcatttactttccctgtcatattgtgcaagttactcaatagctcaattgagctgtactcaatagctcactcaagctgtactcaatagctcactcattacttggaagctcacctagattatcacattctcagtatgtcacactactgcaacactccatcttgtcactgggtattggtgcacttcagatacagccatagtaatgtttctttggtgctttattgtaagatcttttgataaatactgtggtatcaagattgaagttcaataaatgaactttggcttttctacatgtcatatctaactgaattactccacggccttggcgtttattaattggcattctccttttttgctcagccagagagaaatactggcactttcaatgattcattttcttgtagaagatacatcttagaacttttgttgtatgttttctgaatcctgagagcggtatgctgatccagattgttgttgagagctgaggctatggataatgatgtgtttgtatggtgttcacattaaagggaatgtagctgaaagaggatggtgggaagaagttatgaacacaacagataggctaggcagaatgttctggtgtcgaaaccattgctatataattttatcattcttatcatctgtcctccaagattatatgtaaaagaactaaaagaataactttctctgcagatgattcttggttgtaaataccattgtttgattctcccagttatgagagggaatccttttccagtacaggaggaagtactgtatcaagccaccctgacaccctgagtactcttgggagactcttctttggagagaatggactctaggagtccccttcatggatcttagaaaaaaagatcactcgattatctaactctagttcggatctttagttctgggcttgaagctggttggagggcatcttcactgaattccttcctatcatatcagctgaactcgttacctcctcaccaaatctgcttttccttctcagctaccagatttctgctagtagttctattaagcttctagttcttgagacagaaacagcagaacttctgcttggctcatcccttctatccctttggccagtattccatgtattttaaaatattttccttaacaataatttccagaagaggcatttcatttccattcttgcagccatccctagatcatcatttcctcatgcttgggttgctccaggtgccccttggcatcccttctgaattccatttctcctatccattccgttacatgtgggattagaatttctcttttttacatccaacttttgttattatttctacccaacttcagtacatatagtggtttattactgtacgttgagccaagttcaaacactgtcttctatcatctaagaccctacctctgtgcctctataggttcacttaggctatacttctatgcagattttaaagacaactgtctacacttattccaaacctttgaattctaaaatcctttccactttcttgatgaagtcttttatccccaattccagaacgcagagttgaaagatcccattgatggcagggagcaggaatatttcatcaaattccagatatccagcttaggaaagaaatgatagttaatacttttaaatcctttgatttttcagggctataaagcactgtgtaaacatgggagggcaggttacgtgcttaaagataaacccgcatgccctaagtaaatgttgcagagtaattaagctgagagaaattcacagttgatttccaaggataacaataacataagtggtaatctcaataatttgagaggttaccatatttcttaaacagaagctttgtcatcttttacagcgaacacacttggtaattgtctatgtattactcatttatttggcttatgatatccttttccaaattccagtttattatcaatatgttggggatcatgttttatgatatagcagcaagggtattgcattttgccaagatcattgtgagtcttcacctttaaattactctgtgtttacacaacatcagttaatagccattatatggtgctaggaagagcagtgagcccagataaaaacttaaagtcttaaaagacttaagtttatgtttggcaccttgaaatgataatgtagccattggtcaagtgaaaggatgtaaggggagccaggttattgagttactcagtcctggctttgcttctggaaagctctttgacttgatcagtaagtcacattttcttataaactgtgaaatccttctaagtaaaatgagacagtatgtgttcagctaaacatactcattaaacgttcgattaaatgactattgaacactatactaacctcaaaatattttagaatagtgatctctaaggttctggcaaatgtttctctgaatattcaccacagtctgatttgggggactagaaagactggattatgggaatggcagaggtggcaactttgttttaaaaagtctttgctgttagacttcactttgaggttaaatgaagtggccagcctaacaagctaaatttcaaaacctgactcaagatgcacatattataaaatagcctacatttaagatatttcacagagtcgagactaattttattcattcgttagttcaaacttgctgcacataaaaacagctagagaacattttgatgaatagagggtgatttgaaattcctttatcatcaagtgctttcaacttctaaaattcctgctctatttgaagatgggatactttgtctcattctactcattttcttcatgtggagactttctggttccaccttttttgttcacaacatcaggttcttttgtgctgctataacataatgcccaagactgagtaatttatcaaacacagaaatttacttatcatagttatggatggagactagaaagaacaagaccaaggtgctggcatcttgtgaggaccttcttgctgcatcctcacatggcagcacgtagacagcaagagacagcccactgtctcctttataagggcacctaattccctttgtctgggaggaggcttcatggcctaatcacctcttaaaggccccactgttaatactaacatactggcaacacgtgaattttggagggggcacattccagccaaagcaccagtctaactgaaattgctctaagtcttctattttcttagacttctgttttcttagggcaagcttctccatttgtctactgaattacaaactatccaaacttagtggtttgcagcaacaattgttttattatatgtagtgattttgtaagtcagagattctgccagggtttggctgaatggttctgttccacatagcatttactgggattacatgatatggtggtatttagttggtggctgatcttgtctggaggtttcaagatgactttactcacatacctggtaccttggtgaaaatggtggtaagactgactgcaccctcttcccctccatgtagtcacggagtctctcttggtactctctccagcagggtagctgaacttcttacatggtggctcagtgctgcaagagacagaggcaaaagcttccagttctcttaaataccacacctaaaccagcatagtatcacttttgatgcattttgttgatcagatcagtctcagggcggcccagcttcaacaggaacagcgacagactccacctcttgacacaaagtgtgttaagagaacttgatggccattttaaacaactgcagaggaatgcttattttttttttcagagtagcataaaggctgctgttaatggtgaaggctgtggtgacctggacaatacagatcagagcaggatggggtggcacaggttagaggagtcagcactgggaatagggtgggtggcagagttgagtgactgaggtctaatgcgaattgtgaggagctcctcctgttccctccagtggcaggaaatggttgatgccactgactcactcaagctgactctgcctcagtctgggatcatgtccttttaaccagcttgcatttgtccttgcaactttgccctctttctttcctgaatgctgtagttgctgaagttttgattttctttttttttaaatcttagatctgctgtttcctaatgccctaatggtttatgcatttcaaggcgcctgtaatcttatcagtaaattattttcaccccatattgtggaaagacatagggaattactttcgagaaagtttctagttgataattgatttcacctttagaataggcttttgagaatagggtggcaatttctcttttttatacaaaaatatgtgagaaagtatttttaaaactaaaaggcccacatgcttactacagaaaatgtgttaggagagaaagtctgtgacagattcctttaggttttttctggttcttctctctacccattacactggtcagcccacaagcacctggggcttctctgttttcctgtaacagtaggaatcatggattatcatttagtggttttcattttactactttctgtttgcttctctttttctctatttcctaggctctgtcccagaaattctgatttaattcttaaggagtggatcccaggcctgcttatttttgtaatttgccaggtgatccaaatgtgcagctaagattaataaccattggtctagagcagcagttttccaacattgttctgtattagcatcacgtagagagctaataaaatccttagcactccagcttcagtgaaggaggataaggcctgagcttttatacttttcctgaattttccaggtgattctgacagggaccatagtttgagaatatagtaaaatgtgtttgacacaatgtgcaaagttgtacatttttcagcagttctgtaggtcgttatgttggaagggactttggcaaaatatggaatgttttcagtctctgtttttatattgttaggcatgattattatagtcttcttggtaatccagtatatgaaagcttgaaaaataatgacacgtttgggacttgataaaagatagggagttgagaaaataggcagttctatattattttctattatttattttcacaatggttttgattttttctatatagcgttaacttctttgaaataattattcataaatatttaagatatacaaaaatatataaccattatccagcttaagaaataaaatattatcagcagagatgaagtcccccacgcatatcccttctgtattattaccttttcctccatcctctttagaagtaaccacacttttgaaattgatatttaccatgcattcctttcaacctttactacctctatatatacttgtaaataatagatatatacagcctataaacaaaatgcatttttgtttatgcgcttaacattgtgagatttaactatgttgatagatatctctagttcatttattttgctataaaactggtacacaattgtataaaattatgtcaattttatggcaaaaataaatcaaaatcattctacagtaaaaaaagtttttcttcaatatattgaagttacatcagtcccattctgaatatttttgtaagtttttttttacttgcatctgtgtgattttagatatatatcttaagtttactagacattatcaaattgatctccaaagtggctgtgccgatttaccatctcactgtcattttctgtatcttctttggaattgacagtcttttaaagttttgccatttgaggattataaaatagtgttctgttgtggtttcagtgctaatttttctgaatactaatattggtgaacatctctcatttagttcttttctgtgaatttttctgtcttgcccgattttatattgagatgtttatcttcttgatgtgtacagtcttcccgtttgttcattcatgtgattctggattcttattcttatcatatatgttgcaaatatttactgttaagaggctttgctcatctattttatactgtcttgatgaacaaaagttttacattttaatagagtcaagcctatcaacaattgtgacttatgttttgataactatgtattcccatattacattgtatctcaaaaacaattccaggaagactaaaagcctaaaggcaaaaaacaaaaagttatagatttaagaagagaaaaaaagaatctaatataataataattgagttattcattctattttttctataaattttcttgaatttctaccgagacaatattttgtctggaagtaatggatgatttggcttcattgttttcagtcttgtacatttttctttcttgtcctcttgaattgttagaacctccaatatatttttaaattataagcaatcatagtgatggatcacttaggtttttttttctgattttaaaaggaatccttttaatatgttaccatttagtaagatacttgttgtacagttttggtggatatccatgatcaaactaaggaagttgcttttcattccaagtttgctaaaaattttattatgatagctgatgaattcaaatgattatatggtatactttttaaaatgagttttttttaatgaatcacacaagtagattttctattattaaaggatctccttatttctggaggaaacaccacttggttattattcgtttaatatgtactgatttctgttattaatcctttgtgtgctttttcttttaggcttttgcatttatgttcatggataagactcggctgtagttatcctttatgtttcatgtttgcttttgacataaagtactttctttgtttcttcccttctctctcttttaagtgttaagaagcattgggaattggaggaggagaggattggggtagagcagagcttgattgactcttaagcagtgtcttcagtatctggcttgtctctatctctgaattctattcactactcctcttcgtgttggcgaaagagcctgtatagctattatataaaaagtaacatatctttccatcctttatgtacattatccatcaattactctgggtgttcttaaaatattctgttatgtactatctcccttaattttaccttgtgattctttaaacttttcttgtatatattttgagtctttattattaggtatatatccagttttagctgtaatatcttgaaactttaatcatcatgtactgactctatgtctctctaataatgaatttttacttaaagtctatttgcctgatattagtatggcttttattttattttattgttttgagatggagtgccactctgtcacccaggctggagtgcagtggcacaatctcggctcgctgcaacctctgcctcctgggttcaagtgagtctcctgcttcagcctcctgagtagctgggactacagccatgaaccaccacagccagctaatttttgtatttttagtagagacggggtttcaccatgttggccaggctggtctcaaactcctgacctcgagtgatctgcctgcctcccaaagtgctgggattacaggcgagagccactgcacccagctggcattctttttacatatttgttttcccctttactttcagggcttttgtgagctttagtttaggatgtgtaaactataagaaacatttagttggacttacttctttaaatgtaatctgactatctttgtcttttaaatatttaaaccatgtgatagttgacatgacacattctttctaaggtctcattttgtgccttctcttcatcctgtttatgtgctagtccccacccctactccttcataaacatgtcttttttcttaattttttggatcgaggatttccacactccccacaactctaacaattttccttcagtactgttttggtagttacacattctatattattttggcagtttctcttaaatttttaattctcatatccaacttaaaggggcattttgtgtcctgggcctaattctttttgtgtgccctaattctattcatgccatcattttctgtagtttctttctaaatctattttcctaggttttacatagtttgctttgtcttattatgtgggtcttgcaccatgtctcttcccacttcttgcaatggctcagctctactgtagaagctggcatttttgagttggccaacaaagactgtttgcattccttgctcttttggccactctgatctttgtcctttccagtttaatggaaaaattattaaactctgggctgtatacaaaaaccatcatgcttaacacccttttcaacacttttttttctttttatgctgaggtttcctctgagtgggttttacaagaacaaagacaaaaccgtggattgaggttgagttcacagtgacacctgatcttacggcagtataaaccacatatggacatcgttgtttatccctcatattggctattagtgtaaaaaatagcatttaattaaatttcattatttgtataactaagcaaaacatttttctgaccatttgcaaggctgtattctcctgaaaatgtgcttagagatactcaacccagagtatagaaaaaaaagaaatggatagtaagagaaccaagttttgttcttgccttctcaatagctgagtaacctttggcaggtcactttacctcggagaagctttaccaccatgggccaaaggtaattcatctgtaaaatgatctggtaggatgtattagttatctattgctgtgtaataaattattccaaaatttaatggcctaatatgacaaatattttctcacagcttctgtagtcagacatctgaccttggcttagctaggtgcctctggctcagtgtctcttggaaggctgcagtcaaagtgtcttccaggactatgggatgatcgttttcaagctcactcatgcaattgttggtaggattcagctcttcaggtgttgttggattgagagcctcagttcattgctggctgctagctggagacctccctcagttccttaccatgtgagcccctccacagtgtgacaacttgcctctcccagaatgaggactccaacagagaaggtgaaagagagcaagcaagacagaaacttcaatctttctgtgatctaatcttgaaagcagcgtctcattgttttctcttgtttctattacttgcaaatcacttgattcagcatgcactcaagaggagagagttctttgtccttttttgtatttaacttggttgcttctcccaaattagttggtgtgagaaagaaactatcttcattttggcttctacttgattcagtcattaattatgttagaaggcacacacctttcttaagtaagaatctatttgggtgtcaagaaagactactttctgcctctggaggagttgagagactgtaaacatgtcatatatctcacatatgtataatccatataaatgtaaggcatatatttaaaagtcaaaacaacattagtttgatttgaaagcttcagaatacagatgattgcaaagtcttattttcatttttaaaagtcaaagccgatataaatgaagctccatttgtaattttggattactggtgatatagctatattattgtttagactatttaaatatatttatgagtttttttttttgtgataaaagttatagaatgcattttgcttcccatactgttacataagaaggacactggtcagaaaaattggttgtgggtagaaactctgccattgcttggtatatggcacaatttatctaaatgtcagtttccttatttgtaaaatgaaattattcataccagagtctcaaattagatgtttcgtgctttataaatgatcatgttctacaactaaatggagcttctttgactaacctcttgtttcaggccacatgtgaccaacgtggctgttgctggaatccccagggagctgtaagtgttccctggtgctactattccaagaatcatagctaccatgtagagggcaaccttgtcaacacaaatgcaggtaagccagagtctgccatgatgcaggaggtccagaccctctggaggttgactctgtatcccccaggggcagcctgcagagttctgctctgtggggccatataaccacatgtgacagaaggtgggcattgctcttaatcgaggactagaatctatgtgggcaccaaggaaaaattattctctgccttgggagttgagagaccatgtcctctttccaacttccccatttatggaccttcatgactgcaataatcattgatcatttttgttttcaagtttatcccttttaaagtgggggatttgaaattggtaacctctcagactacttccaactgtaattttatgttatttttatgaaatggaagtaattccaattttataaacatgttatgaaagttactagtcaatataagtgttcatggagtgaatagcccctcttcttcctcctactctaaaatgcaaagcataggccaggcacagtggctcatgcctgtaatcacagcactttgggaggccgaggtggatagatcacctgagctcaggagtttgagactagcttggccaacatggcgaaaccccatctctactaaaaatataaaaattagccaggtgtagtggcatgtgcctgtagtcccagctactcaggaggctgagccaggagaatcgcctgaacccaggaggcagaggttgcagtgagctgagattgtgccacttcgctccagcctgggtgacagagcgagactccgtctcaaaaaaaaaaaaaaaaatgcagagtataatgatgacaatgatgaccattctaggggatagcagaaggtgacactttagggaggctctcggtataaaggaggaggcatgttcccctttcagatgctcttggcctgatggactgttgcaatgaggtctcaactctcacctggtttaccatttaattagggagatggcatcaatggatataatcacctgtaatgcaatatgaaaataactgagaaggaattatgtatatgtatgtcaggtctgagaatgtaaagggtatctaattaataccgaatgactgatgggcctgtggaatgagtgttaggcttattgggggaggttttcaatcagattttgtagaagagagacatagatttttataaaatgtaatgatgatatctagctccagaatctgccatagatagtatgtgcgtatgatggggtatatatctgtcttttcccttcttttgagaaataaagatttttcatcaatccctttgacatgtatcctaatatatatatatatatattttttttttttttttgagaaggagcctcactctgtcatgcaggctggagctgtggtgcgatctcagctcactgcaacctccacctctggggttgaagcaattctcctgcctacaaagtagctgggattacaggcatgcaccaccatacccggctaatttttgtatttttagtagagatggggtttcaccacgttggtcaggctggtctcgaattcctgaccttgtgatccacctgccttggcctcccaaagtgctgggattacaggtgtgaaccactgcacccagccccgtgtatcataatttttatgtagctattatttgagaatttgcagagtcaactatgaaaaccttttttttctcctatgttaggattcacagcccggttgaaaaatctgccttcttcaccagtgtttggaagcaatgttgacaatgttcttctcacagcagaatatcagacatctaatcgtttccactttaaggttgtaatttgtttatttttttttaagtttttttgagagacttttattccctatcggatgagtgcagttactacaaaatagaaaattttgctactggatgtatttttctatattgctattattaattagcacctgtatgttaaagacatatacagaatagcttcctttactgtaataacttcctgaatatgtattacagtttactagtgagtttggctttcattcatttactctagataacatgtggaatatggtaggaagataaaataaggaagtatcacagctttcaatccatctctgcagatgtgctctgtatgtctctacctaaagactaacttatgcccaaaggtgaaccatttgagtttggtaacataatgagtacatctacctaagatatgaggtcagtttgatcagtgcctgattccagtatcctaagtagggatattgggaagctctgacaagtttttattttggctttccttctatttctatctctgcacagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtaagttttggaaacctatctaaggatcagagtaggaaggttacagggaggtctgtaagcatgaagaagggggtgtttcaacaatattcctgaaggttgtgggcccattattggtgaccagaacctttaccttctaaagtatacatttttttctggctttctttctctttcctctgtttgcacaatcatttttttctctttatttttccctttatttccctccgtctataatatataaccagctgtccaccagtaaatatttactgaacatctcctatcgtaagtatagtgttctggtcatgtagtaggctgtctggtctgggagactaatgcaagaaatttgcacatggtccctttcttcaaggagtccttatctcttgttttccatagaaaaatgtcacaggagggcaaatgggactgaatgaatgggggctattgagtcactgagatataaaggacgcttttctaagcacttacgttctctccaccctgcttgctcacccatccttgtgttctccacctgtgtctaggtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggagtaagctttcaaatgggcccctttccactgaatatcatagtctcattcttaaaggtcacctctagtattacagtgtagtgtttaagagttagagtctagagtgagactacctggctttgaattctagtcttgctattcaccagttacgtggttctgggtgttacctacctctctgtcttcagtttcttatctataaaatggaagtaatatctcaatagggttgtggtgaggatgaaatgaacagatacatgtaatgtatctagaagaatggctgccagaaagaaggtactcaataaatgccaactccttcatattttcctaaccagatatggagaagatattattaatatctgtactctcaacaacagttgattgtgatctccatatttttaggttcacctttaatcactgactcaccaggtttatcatcacaataggataaagtctcagctaaaacaatcattttttgtataaagaatgattgtggtagtgaaagaatagacagagttttgttgttattgttttattttatttccactttgttttgactgctaaaatttgaagtaacattgttttctggatttggcaatactctgttgttcagggcctttctttttcttttcttcttctctctttgtttgagatggggtctcactgtcacccaggctgaagtacagtggcacaaccatgactcactttagcctcaacctctctgggctcaggtaaccctcgtacctcagtgtctggagtagctgagactaaaggtgcgtgtcaccatgcctggccaaatttttgtattttttttgtagagactgtgtttcgccatgttgttcaggctgatctcaaactcctggactcaagcaatcctctggccttggtctcccgtaagtgctgggattacaaatgtgagccactgtgcccagctgggctttcttgactaagcagaattaatggatggaagaaaggagattacagcaataatttattagtcatatatatatatatatacacacacacacacatacatgtttgtgtatatatatctatttagccatagagtctagaaaatataataatttcttgttagaaaaaaccaaggcccagcgaagccaaattaatagctcaaggcaaaagggtttgtaagaacaagaatggcctgaacccgggaggtggaccttgcaatgagccgagatcgcgccactgcactccagcctgggtgacagagcgagactctgtctcaaaaaaaaagaggttgtaagaacagaggaagaatctaatccctactctgtgtaatttttaagcccaggctctgtactgtacatatgcctatcagaaaagcagaaaagctgttaagtcagagcagcttacctaggaatagttggtgacagttgtttcattaaggagcctcagatccttgcttctcaaagtgtgtatgtggcaggggaaccaccctctgagagaggtgggctttcagtcccttcttccatctattgaattaaaatctgcatttagggctgggagcagtggctcacgtctgtaatcccaacagtttgggaggccaaggcgtgtggatcatttgaggtcaggagttcaagatcaacctggtgaaaccctgtctctactaaaaatacaaaaaattagctgggcatggtggtggcgggtgcctgtagtcccagctacttgggaggctgaggcaggagaatggcatgaacccaggaggcagagcttgcagtgaaccgagattgagccgctgcactccagcctgggtgacagagtgagactccatctcaaaaaaataaaataaaataaaaaccgaaacaaaaattagccaggcggtagtggcacacgcctgtaatcctagctactcaggaggctgaggcaggagaattgcttgagcctgggaggtggaggttaccgtgagccaagatcacactactgcactccagtctgggcgacagagtgagaccctgtctggaaaaaaaaaaaaaaaaatctgcatttaactaaaatgcccatgtagtttgcagatacaccaaattttgagaaacacttttccagagcaatagttatcaaatgtgactacatgttgaagttacctggggaagttaaaaaataacagccatgtctgcttctacctctagggattctgttttaattggtctggggtgcagtctaggttgagaactcctgttctggagtctcaaagacaagcctagactagagctccatctagttacctgattcatattaaagcatattgatggagcttttgctgatgaggttaagtcaggttaagacaggcctctttgagagggcagtttttctgaattacattttaaaaattcctatcctcttaccttctaaaaaatatcacagccttcacattccttctagatgaatgataatagctggctcattctgtaagaaaacatgagttcacttggttaacatcaactagatatagaccccatcttttaaaaatgtgtctttatgaccctgaatgtcctgtcaattagttgcatgattaagactgatttcctaaaccaaccccacagtgtgatgctgagacttcttagttgtaaattttggtttttaattctctttctgcagaacggaactaatttgtatggtgcgcagacattcttcttgtgccttgaagatgctagtggattgtcctttggggtgtttctgatgaacagcaatgccatgggtaaaggaatattcatggaaaaaacaagcacaagagtgattttcagtccctttcttacagcactatgataaaaggaatggatccctttaagagtgactgagccatagtgtagggagggccttatagattctctaattgtgctatccctacttcattacctattgatccatggtagccatgagtaggggattttctccaacttatgattttcctgaatctggtggcctctgttggaatattttctattatcaagttaaggagctcacccttccctataatttactctgagatagtttccaccaatgtgttcttctccgtcttcagccctgtagtcagtagatcccagtggcaatgaattgccataggggaagagaagatgtatcagaatctcccaggattgatggtgggcatagggtattgatccataccttttcttaattgagagtcatcgattcaatcagtgctcctcaaagtgtggtccctgaatgggtcacagactgtttcaggtctatagtaagatgagtatagaaatggcgagtaagcaatgctgtagcctccacacgcacacatgaacctttttctagtaattaattttcatattattttatgaaaatatcagcttgcagtgaaatggaaattaaacaaaataaagatctgattctccaccacagatatccgagaagcactctaaatgatctaacatgattctaggacatctaagagatgaatctaagacgattctaatagaatcttagatggtcctaaggtacttaaaataccaaataacctaagaatagactgagataatataatagaaagactgtacagttttagataggtgaaaggaaccagaaaataagatgagtcagacttagtgggaaaggccacaagatcctagatactctgtatgagttgttcctatgaccaaagagtacattgcaatatttcttgaggcattttattcctagatacgaatcaaggtaatgacacaacttttaagaatggtgattggcacatagaagggttttgaatttatgatacaatttctgactttttttttttagtttggcttttgtttgaggtgagattcactgaggttagttacctccatgtctagttgaattatattctcacaataatgacggggtatgtggtgggacatgttctgtggttatgaaagtcagagaggagaaacttttcctctaacctcttagggttaattcttgggaggctgcaaattaaactggcaaaaaggtagattagcaatagaaaagacagaatttatttacacatacaatgcacatacacacagcaattctcagtgatgagtaactcaaagcagagattagaacttggggcttctataccatcttaattaataggtgaaagggaatggggaaagacacttaggagagaacaaatgacattttggaaagataaatgggcccttaggagagtaggtgggaggatgtgatagtcttgtaacactgtttatctgggaatggtgcctgttgtctcagagaagactagaggtactccttggagcagatttatgacaattgctttttattgagttcttttgggaggctctgattttagcacatcagggatttcagtaacttaaatgcctttggtccaaaataatttttttatgtcacagtggcttattctggaccccttcataagcctggctgctttttccccagaacctggggcctggcacaagacactaagacactccagtcagtattattaaaatctgtcacagaaaaaatgccttggctgccatgtgctgtgagggtggacttggatggtcagggttttcacttggtattcaaaatgtgaggcactagggtcaccttgttaatgttcacatggttagtgatcctgtgttattttaaaacttgtagttactattcaagaatcaattctgatttttattttcttcatttttaacctttcaagaggttgtccttcagcctgcgccagccatcacttaccgcaccattgggggcattctcgacttctatgtgttcttgggaaacactccagagcaagttgttcaagaatatctagaggtaaacttaggatgtcaagattatgactcaggaaatcctaaacagcaaatattttaaaaaagtaaaattcatgtgcaagtgtgacccacaaaatctgctgttacaaatttgagatattaaagaacagatttcatatatgcaatggaaacttgctgtatagcatttttatgttataagaaggtgagagaatataaaggtgccccaaacatggccctaccctcaaacatttatgaaggggctggaaaaatagactaacattctaacattaatgaatcagtgcattgggaaatggactatgtttggtgctctgaaagcaatgcttcgaaaaatttttattaaaaacagagtatttgctaattttcacttcacatatttctttcagctcattgggcggccagcccttccctcctactgggcgcttggatttcacctcagtcgttacgaatatggaaccttagacaacatgagggaagtcgtggagagaaatcgcgcagcacagctcccttatgtaagcaaggttttcaacagttctccaaaagtaaagaaattcccttgaagaaaaagaaaaactgtttatattttctctccctgagtttaattgatttatttatttggtaatgaaaggagttttagatattcagaatactagacatttttttttttgttggaccagtaattttttcaaggaaccattgttctttatagtatgaaatagattgggagaccataattatgtgttgggaggcaatctgtttttgtctctatttttcttattatgtattttattagtaaactttttttgtgcttactgtattgactacattttacaggtgtttttatttgagttttcaaggcatttgtctctttagcttgaattgtagcattttaatgcttctcagtatggattttcttgccttacacatgttcttggtttgctttgactcaaaagtgtcatggcagggacttaccataaaagttgtatcatattttcagaaattcctctaagattctggcataagatttcatgtctaaattcttaggttcttaggtttagtgtcaggtcaagaatgatgcagatccccaggctccctacctatgttttaacagatattttaaagaggaattgaggaagtggagtagttctagaccccatgaatttagttcaaactaattatattgctagaacaaccatgagccatctgggttagcatcattttttttcacagatagtaaattgaggctgtcaggggaaatactatgaccaagaccacataggtaattgatgacagaacaaatactgcatgtgactacatggatgtgaaaaataatacaagtttcaggtccatgtgtttttacattgatattttgattactattaaattgggaataagcaaaatttgcctttctctttagagtggtcattttgccattgaagctgagcttcagtagacattttgtaatttgacggaaagatagtccataaatatgatgtgtaaaagaaagtgcttaatggaattgagattcaaaaagcctaggaacactgaggagatgggggaagcagaaagtcagggcagataaagacgtttgggtggatgaattcactctcaatttggctgcgagtcccactactcattctccagcatgacgtgtctttatgcatgtgggggtgggttgggggagggataacagaaaaagtggtaaaagcaggactgagccaaaggacaattaacacagccaccataataatgagtgctacaacgtggtgaactctcgtggcaggcagtgtgctacatgccttctttagttatctcagcaactccattttactattagaattccattggctgggcacagtggctcacacttgtaatcccagcacttgggaagccaaggcaggcagatcacgaggtcaggagttcgagaccagcctggccaacacagtgaaaccccgtctctactaaaaatacaacaacaacaaaaaaattagctgggcatggtggcaggtgcctgtaatcccagctattcgggaagctgagacatgagaatcacttgaaccctggaggtggaggttgcagtgagctgagatcgtgccactgtattccagcctgggcaacagagctagactcagtcttgagggaaaaaaaaggactccatttaagattagaaatcccatttaatattagaaaactaggggaactagttttcaagcccagatctctaacatcatagaggtcatctctttttttatgccattttccttacttatagatagacatttcctttttaagtgatccaggaaatgaaagaattggactgttactgctgcctagtggtgtgagatgtgagagggagtgtttagacagggaattgaacactattacctgagttcagtatacatgtcaaaatctgtcacatttaagtgaatgaaaggatatagtatggacatgtaataaaacatttttgtactttgaatggctaagtttgaatgtacctatgatattggatactattgggagtgaaatttaacaagagatgcaaagggaaaagctcagtagtcttctagaataatcctcttctctcccccactctattccattggagacaaacctaggttgtagagaagggtacattttattctgggcttcactgtttatacaggtaaaattgggatagcataaacaacaaagatgtggggtagaagcgaagtaacaaaataaaatgtggggtagtaaaatgagggagatgtgggagagagacagtctcttcccttctttatcttgtgaatagggtgaaatttaggtcatttcttaggtggatatgtctgattgtcttaggggtttgtcataattggtgttgcttgcttgattggtttttaatgccagagtgccaggcaaggattggatgatgcagttaacctgatggcagggagggggccaagccctagggaaccaaccagtcgtgtgtttttgaaatcaacattggaaaagaagtactcagatgccaggaactgattaagaactctatttagagcccagaacagagttgtttatcctgaataataacagtgaaaatttgatttcattttactatggaaattcctaggtgctaattgtggactttgtatattctttcaggatgttcagcatgctgatattgattatatggatgagagaagggacttcacttatgattcagtggattttaaaggcttccctgaatttgtcaacgagttacacaataatggacagaagcttgtcatcattgtggtatgtactgccctctttccaccaaattaggtatttgctcctccgtatcatacacccatctctcctgctttctcccccagttcccagtctcctttcagtgcctccggtttccagctagtttgttcattgtattcttcctatttttaggatccagccatctccaacaactcttcctcaagtaaaccctatggcccatatgacaggggttcagatatgaagatatgggtgaatagttcagatggagtgactccactcattggggaggtaacttaatgggaaggctggaggctggtggaggggctgcataggggtgtttgaatgtgtctgtgtgtgtgtgtgtgtgtgtgcatgtaattgttttattgtacattttcagtatatttatatatgctggggataaattctcctctgccctttcatgcccaagtgcaagccggccatcgtagctttttgattcccttcacagccaagtaagtccctttaaacaacagctcacacactgagtgtccactttctcacctcccacacactctgcagctgactgtggtctccttccttcccccctcacttccctgataccgctctggcaaaaagcacccgttactttctcactggtaagtccagcggaactgtttcatacctcttcttactcaattttcctgcattatttgacaagtgtacccacttctttctcaaatgtttgtttgtccttgttttttcaggaaggtgttatctgcttgttcacttctaaggcctctgatgaccttttcagagtatagtgtctgggggaaattggataggaaagaaagagagaaaagtaaatgatgttagaatccacagcttatagtggactagctgaaatttacacaatgctcttcccccatttactattcccagaattaagaacaaagaagtgtagagagttaaagatgactaagttagacaatgcctttatccacgaatttattcattaaggacttaaacatttttttaaatgcatatttcttcgagtgaccctggcatttattttaagtattgtgagcaccgcaccttcttaactaaaaaggatatgttcctgggtacctcggttgctgtgatcatattaggaatttctttgcaaagtactttcctttagtctatatttgtttaatttactcttaccagtgtttttctttttctcctgaaggtctggcctggacaaactgtgtttcctgattataccaatcccaactgtgctgtttggtggacaaaggaatttgagctttttcacaatcaagtagagtttgatggaatctggattgtgagttgtttacacttggattattaggtgacaaatattcaaattgtgtatatctgtatctgtatctttgagtcacagagcatagggagaggaggaggagaagaaaggaagtataacaatcactctcaatattcactctcttactatttaaataatcttgctaaaacacatagcttagaataaaaatcaaaatgttagagctgaaaggaaactcagaattttttttcccaagtctagctctttttttttttttttttttttacgaaggaatgagctgaagtcagaataggtcatgtactccttacattgttgcaaagtatacaaattgttcaattgctagttgaagactcttccttttggacatgttgaacaaattgatcagagccaaagtactcaggtgcatgaacaaactatgcctgtggtaaagaaaaatgtctcatatgatgtcagatgaaagaaagtaacctaactgagggttagcaaaatttagggagctccagagttgaaactttttctttttctaagagaactgtagaaaattcaaacaatacagagagttaaaaagataaaagcaaaaatcctcttaaattatagcaactaaagacatttattatcgatacgttggaatgcatctttctagacctttatgtgctctctctctccttttctctccacatatatgtttatatgtatttatatgtatatgtatttacagttatatttcgatatatggaaaaatgtataagttgaaacatgtcatcatataaattgaaacttttttcacctgatatgtttgggaattgttcattttcagcgattatagacatattatttgaagagaggttaagaaccttcttcatgaagccttcagtgggtagacaagacaagaacacctactctattccatttatacaaatacccctttaaaatatctggaataatttatctgattaattaaaaaaagacaccatcacgacatcataagataacatgttactttttcttaatagtttttgctctttgtcttgtaggatatgaatgaagtctccaactttgttgatggttcggtctcaggatgttccacaaacaacctaaataatcccccattcactcccagtaagtcttggtggtcagcagattaaagtagccatatgtatttcatattataaattcataaggacagatctgaaaaatctggcaagggaatttgttcataattgtgcatagaaaaagaaatatgtgggtaatatataaggaaaactaggaaggaaaataaaaacacactatgctttcctaaaacatgcacaaattcaaaaggggcaatctagtacttctacttatactcaaagctatttctagggaagatctagagaggataaagtgtagaggccagaggctagtggtaagtttatgtcattctcaggtatgcacccacaggccagggtttaccagagagacaccaggtaaccagccttggtcatcaggtaagggttatgtctgatgtgtccacagtgtgaagaactgagttacaggatgaaaagacagaactcatgacctgggaggtcaaagtcagtgaacgtgatgatactcagctttgattgaactttggacaacactatctctcagggtgtggccttggcatcatagcatcggccatagtttgaagaatgctagaggttcaaggacagattatatcttgattgagaaaggaaaaaactgctaagatgataataacttatgaaggcttcaatatggtgggaagacaggaaattggggcaggaaggttagaatcaaatgctgaggggcttggatgagaggctaaacagttcatattttactcttttggtgttagaagctacttatcttttagtaatagagaagcatggtagtcagatgattttggaaatatgaacctgacattaatatatagtgtgaactagaaatagatacataggaggtaaataagacatgacgaagctactgcaatagttaagatccacagataatgtggatctcaaacagagtggtgcaatgggagcagagaggaatagatgaatacaggagagactggaaatcattctctacaatatatgatcaggggagagaaggagtcagaaattaatttacactttcattcagtatttccattcttggaccacttaacttagctcagtttggagaattcagattgaacctcaggcctgaatgaatcttcttacttccaagtgtctgcctctaatcacgtgagagctccagtgggaggatgtgtgtgggtcagcagaattcatttatatatcagagaaactactccaagtggatagcattctaatagtaagggagcagtgtgactgtttacaggatgcccacaaaagtgcctgcccagggggctgtcatttcggattgtgatagtcaaggagcagaaaatgtgcaacttaggctctcactgattgatcctgcttttgtttcaggaatcctggatgggtacctgttctgcaagactctctgtatggatgcagtgcagcactggggcaagcagtatgacattcacaatctgtatggctactccatggcggtcgccacagcagagtaaggccactatggctatgacctgctaattattgaatataaagaatatatatatgtttttaattcttggagattatggggctaatgcataaaatttcttaagacaaaacaaagcaaaacaaaacatttaatgatacagaatgctcccaacagggactctaattgtaccgaaagagagttggaagagaatgggttattcacttttaatgtcttttgtattgttgctgtatccccttggctgagacaagctaagatcccacattgactccttaaatctctctcccttgcagagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgagctgctacctcaagctctcttatgaacctgaattcccaggcaacctcattctagaaagttttcaaaccacaaagctcccctctcctgcctgccatggctggggatttaatatcttgagagcatgtgcttcatccacatcagcagggctttgataccatgacattctttcctgtactgccttatgaagacagaacgtgcaactttgatatgtgctggaatatatctttctattaaagtgtaacatactttatacagaaaagtgtatgtatccttaagaacacagctgatgaatttcaccacctgaacacatctgtgtatctagtaccaagatgaagaactataacattgccagcaccctacagtctttggcattttttagttaaatccaacatatttatgaattgaactcctagagtgttcaaggtcttgagcagagtaggcatggtgagagggaaggaaagcataaatatagtaaagatgtaccttctctttgccccaagggtttacagtttagtaagaggagacagatgtgtaaacaaataattgtgacaaactagggtaaaaagaccaacagggacgtatgagttaaatgttatgggagatcccgagaaagggatttatctgacaaaattatgagggacaaaaggaatcaaggcagggagtcaaggacacttcatggaaaagatgacatttgagattaaccttgaaaagtgagtattttttcatctgactaatcaggggggaagttcattttaacactgagaaataaaaatgagcacaaacagtataagggggattatttgatgtatctataaggattggtgtgtgggactggaatgagaaatgatgctaaaaagatgggttggaaccaggttttaaagatctaaaaggttgaacagcaaggaagtcccggagattttttaataggtgagtgacatggtcagacttaggctttagaaaaataatgctgatagtggtgaggtcaaaataataatatcagcagtattactaggtactatgcatccaaaagctctttatgtaaagtgtattacttttattacctcattcatttacgaaatacctgtgtagtaatttagtactcactgacaaaatgaggaaattgaggcacagaagggttaggtaacttactcaaagtcatccagcattcaagagtggacacaggctatgaccaaattttgaccaccctcctagccttctcggtaggaggtttaagcaaggttcagttgggaggtccctggtggaaagcaaaggagggtggttagaaggaagtgaggtatacctgttgtctgtgtgtccttccaggtgggtcctgacatatgtggctttgctttggacacccctgaggagctctgtaggcggtggatgcagttgggtgcattttatccgttttctagaaatcacaatggccaaggctacaaggtaaggctcctaggacatagagtcagaataaatttggcatacattaggactagatctgtctgcatccttgccaagagatctgctgaaccaacctcttacctggtcttcacttactctaatttgcactatcatgtgcaattaaccagaatctgtgctgtatcatcgaaatgcccaacggcctcagcctgttatttactgttgcattcaaggaaatggtgtgtctgtaaaggtctttcatcaaacttctgtacgctttatctacattgtttgcttttaaataagaagcaaacaaggaaatacttcaaaattatttaaattgcagcctcccaagagaggaatcttaaagaatgaggaaggcaggttgaatcgaaaactcaaggagagacacttggtactactcagaagcgaggtttgcaaccttggcctctgtcattcaggagggaaattcttggttgtaatgaatgaggtctggaattctgcaggtgcttctgctatcctgcagccaaaccacaactgcaaactcctatttcctcccaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagtaagttcacctaacctccttaaattttattaatgcatctggaatgacattgactatatcatcaaatatcagagtgaaaactgaaacaattcaggcagttattcatatctatctgtatctatatctgtaatctagctatctatattcattaatctatctatctatctatctaactggaatacctagttggtatttgtaagcatcgcctgttcccttttggtgagagaattagactaaaagtcatgggactacaggtcttttctttgttctgccattcactaactctgtatcttagacaaatcattttttccttagtttcttcagtcttaattcaaaggatttgaaatcttgactgtgatggtctcatctgtaatgcactataatgccagaactatgttcaagctgtaggaatgagcctataatacaaatacaaatgaggatattataaaggatttgtagaatttcagaattcttatttctcaggcaatgaacatctctaatttaattctaaaacaaggcacttaagagcattttcttgtcaaaatacagtcaactcccttatgtgggtgacatatgaggccctcaggcacgtatcaggctattatatattcattattttgggaagtttttgtctgctcatgaaatttcttgttaaaaggcagatattctgaaagagaaaaaagtaaaatgttaaattatctgatattttgtatgatcagatccagtttcttgatagtcagctgaagttatgaaatgtattgattatttaagtttttaattttaaatttttgttggtacatagtagttgcatatatttatggggtatatgagatgttttgatataagtgtgcgatgtgaaataagaacattatgggaatgaggtatccatcccctcgagcatttatcctttgagttataaagaatccaagcacactctttaagttacttttaaatgtacgattaagttattattgactatagtcaccctattttgctatcaaaaggtaggttttattcattctttctaactatttttttttgtatctgttaaccatcttgacctccctcccagcccctcactacccttcccagcctctggtaaccgtccttctactctctgtgtccataagttcttggcttttagatcccacaaataggtgaaaacatgtgatgtttgtctttatatgcctgacttatttcatgtaacgtaatgatctccagttccatccgtgttgatgcgaatgtccggatctcaacttactttttttaaaaaggagggctatggaaaatagaattacagcctgggacctgcctagcatacatactggaatagaaacatctgtttatcctgagggaagaataggagacatgagctggggaaggggaatctgtctaggggtgcagaggggcttgagtaggtgtcacagaataatttggggggtttgcctgggcagacggcctgcatgctttcaacaggttgtgtgtgagtagagctgctacaaatctcattggcagtggctcaaatctcagtgaactgtctctctggttttcaggttctacgaggacaacagcacttgggatgtgcaccaacagttcttatgggggcccggcctcctcatcactccagttctggatgaagtaagtgttcccacagagatacactagagatctctgcatctgtatctgctgccctgcaaactcctctctgcttcttattccaaactcacttctgacatctgtgactgagtcagccttgaagagagtgtgctaggttttgagaagctagacatctggtaactacacatttttctttctagaatttcttttttctcttgatcaagttcccaaccagtttagaagcatctactggaaactctagagttacaagttatgttaggttgttcttgcattgctatacagaaattcctgacactgagtgatttacaaagaaaagagatttcattggctcacagttctgaaagctttacaagaagcatgatgctggtatctgtgcagcttctagggaggcctcaggaagcttacagtcatggaggaaggtgaagaggagcagcgatgtcatatagcaaaagcaggaacaagacggggtggggggagttgccacacacttttttttttttttttttttgagatggagtctcactctgtcacccaggctggagtgcagtggcacaatcccagctcactgcaacctccaactcctgggttcacatgattctcctgcctcagcctcctgagtagctggggttacaggcacctgccaccaagctcggctaattttgtattttttgtagagacggggtttcatgttagccaggctggtctcaaactgctgacctcagatgatccacctgcctcagcctccaaagtgctgagattacaggtgtgagtcaccgcgcttggccgccacacacttttaaacaaccaaatcttacaagaattcactcactatcaccaggacagaaccaagggaatggtgtaaaccattcatgagaaatctgccctcatcatccagtcagctccctccaggccccacctccaacactggggattacatttcaacatgagatttgggcagacaaacatccaaactatatcaagagtggtcctatttgttgttggattctcatagcagatcctgacttgctccatgacgtagaaacaggatggagcagtgacccaacactcactctaaagtcaggctgatcgggatgtgattgttgtctctgccactttgagcctgtgtgatcaggggtgactattgtgctggcttctcatctgcagaggggtaatactactactactaaaaataatggtacccaccatttgggaatgttgggaaaattaaatgaggtaatcatgtaaagctggaatgtttgtcaccacacatgttttattattattttatgattattattattcctaatgtggctacgtttgggatttctctctgggttgccaagttacagtttctattatttgtattagaggagaagcagaagaaaggcataatagcagggcattcctgccctctctgtgtatgattaagaaattccctagagaataaaaagaaatccattttatttccctcaggggacactacatttttttaatttcagggtgcagagaaagtgatggcatatgtgcctgatgctgtctggtatgactacgagactgtaagtagctttgacttttcttctactccttaagactgtagctgcagctgcatagacaagctacctttctggagagagaaacatccatctacatgctgaggagtagtttttagtgttttctgtaatttcatagcagaacctgggtaaagttaacctaaaccgttaacatcagtcatgatgaaatgtgaaaaaataccttcatatactttatttagcaataagataggctgacatagtatctcataaattaatattggaggaactgatggacaatgtgagcttggtcaggaatcagactatctgtttaaaactatcagtttatataatatatcaaatagcctcagcatggcataaattttttcacaaacccccaactggtagcagaacatgttattcttgatttttttccttctgttgtttgattgcctggctagaccataattcagctaattggaaaagggagagagctgtgtatcaccaggcatgtagataatcagtgaagggcaatatgctgtcatgccaatgtgtttgatttatctgcatgcatcaggggagccaagtgagatggaggaagcaaaaagtcgagatggaacttcctggagacaaaattggacttcaccttcgaggaggctacatcttccccacacagcagccaaatacaaccactctggccaggtatagcatggctggagtgtcctttcagaattcatgtccttgcttaaaccctttgaatttcttttcgaaacacactaacagccaggtggtcagcctctttggtttggccacgactgttgcagttttagcaccaaaagtctcttcccttgggaggcttttcaattctgggcaaaccaggtcagttgatccctctgtctgccttggccacactgcatccatgtttctttacccttgactcacttgttctcatttctagagaaccttgactctcctccctcctagaatttcaacttcctatttcttttctcccactaagatttctttcttgtgattcaaaaattaccttatgcaaacctcaaatctccaagtcactgaattttcctttatatgtaattgattccaaaaaaatagattccatctgtactaaagaggtgcacatttatatcttcatggctttgagagtattagcctacttgtctttaatagaccaggagctctttggaagccagaaacctgtcttttcttttgaacctctcttactgctttaattttccaagttgtagactttttatgatactaatggaaaatatccctgaatccaatgccagttggcttcctttttctaactgttcaccttcaagctgttctgcacactgataccaaattaatttttccaaaatgaaaatctcaactggttgctcccaggcttgaagtccaaagtctttcattaatagggtattcaaaaccaatcacaacctggtttcacgttactttaacaactctatctcctgccacaccttcatgtacatacagaccagtcatgccaaaagctttctctttcccagacatacgtatgtattttacaacatttgggcttttgcacttatcctttccaacattctttgcctggtgtattcttaatgatccaaatgaaactttacatttcagcagcaagaaatctttccttaatcttccagcagaggaagcactgccactttcaagtttctggtcattttatatatatattatatatatacgtataatatataatatatatattatatatatacgtataatatataatatatatattatatatatacatatatataatatatatatattatatatatataatataatatatatatattatatatataatataatatatatatattatattatatacatataatatataatatatatacatataatatataacatacaatatataacatataatatatacatataatatataatatataatatatatacatataatatataacatataatatatatacatataatatataatatataacatattatatatacatataatatataacatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatataatatataatataacatataatatataatatataatatatattatatacatatatataatatataatatatattatatatacatattatatatataatatatattatatatacatattatatataatatataatatatattatatatacatattatatataatatataatatatattatatatacatattatatataatatataatatatattatatatacatattatatataatatataatatatattatgtataatattatatataatatattacatatattatatatacatataatatctgaatataatatatatattatatatacatatatctaaatataatatatatacatataatatctaaatataatatctaaatataatatctatattatatatacatataatatctaaatataatatctacattatatatacatataatatctaaatataatatctatattatatatacatataatatctaaatataatatatatattatatatacatataatatctaaatataatatatatattatatatacatataatatctaaatataatatatataaaatataaacataatatctaaatataatatctatattatatatacatataatatctaaatataatatatatattatatatacatataatatctaaatataatatatatattatatatacatataatatctaaatataatatctatattatatatacatataatatctaaatataatatatatattatatatacatataatatctaaatataatatatatattatatatacatataatatctaaatataatatatatattatatatacatataatatctaaatataatatatatattatatatacatataatatctaaatataatatctatattatatatacatataatatctaaatataatatctatattatatatacatataatatctaaatataatatctatattatatatacatataatatctaaatataatatatatattatatatacatataatatctaaatataatatatatattatatatacatataatatctaaatataatatgaattatatagatatatctaaatatatatattatatatacatatgatatctaaatatataatatatacatataatatctaatatataatacatatattatatatacatatactatctaatatataatacatatattatatatacatatactatctaatatataatacatatattatatatcatgtaatatgtaatatataatatatacattatatacacatacgacatataatatatacattatatacacatacgacatataatatatacattatatacacatacgacgtataatatatacattatatacacatacgacgtataatatatacattatatacacatacgacgtataatatatacattatatacacatacgacgtataatatatacattatatacacatacgacgtttaatatatacattatatacacatacgacgtataatatatacattatatacacatacgacgtataatatatacattatatacacatacgacgtataatatatacattatatacacatacgacgtataatacattatatacacatacgacgtataatatatacattatatacacatacgacgtataatatgtacattatatacacatacgacgtataatatatacattatatacacatacgacatataatatataatatatacattatatacacatacgacatataatatatacattatatacacatacgacatataatatatacattatatacacatacgacatataatatatactatatataatatacacatacgatatataatatataatatatatataatatacacatacgatatatgatatataatgaatattatatacacatacgatatatgatatataatgaatattatatacacatacgatatatataatgaatattatatacacatacgatatatgatatataatgtatattatatacacttacgatatatgatatataatgtatattatacacttacgatatatgatatataatgtatattatatacacgtgtaatatatgatatataatgtatattatatacacgtgtaatatatgatatataatgtatattatatacacgtgtaatatatgatatataatgtatattatatacacgtgtaatatatgatgtataatgaatattatatacacgtgtaatatatgatgtataatgaatattatatacacgtgtaatatatgatatataatgtatattatatacacgtgtaatatatgatatataatgtatattatatacacgtgtaatatatgatatataatgtatattacatacacgtgtaatatatgatatataatgtatattacatacacgtgtaatatatgatatataatgtatattatatacacgtgtaatatatgatatataatgtatattatatacacgtgtaatatatgatatataatgtatattatatacacgtgtaatatatgatatataatatgtatattgtatacacgtgtaatatatgatatataatatgtatattatatatacgtgtaatatatgatatataatatgtatattatatatacgtgcaatatatgatatataatatgtatattatatatcatatatgtgatatataatatatatattatataacatatatgatatataatatatattatataacatatatgtatataatatatattatatatcatataatatatgatatataatatatattatatatacctataatatatgatatataatatatattatatgtacctataatatatgatatataatatatattatatgtccctataatacatgatatataatatatattatatatccctataatacatgatatattatatatattatatatacctataatacatgatatattatatatacctataatacatgatatattatatatattatatatacatacaatatatgatattatatattacatatacatataatatatgatataatatatattatatatacatacaatatatgaatatataatatatattatatatacatacaatatatgaatatataatatatattatatacatacaatatatgaatatataatatatattatatacatacaatatatgaatatataatatatattatatacatacaatatatgaatatataatatataatatatacatacaatgtatgaatatataatatatatcatatatacatacaatgtatgaatatataatatacatatcgtatatacatacaatgtatgaatatatgatatatattatatatacatacaatatgtaatatatatattatatatacatacaatatgtaatatatatattatgtatacatacaatatgtaatatatatattatgtatacatacaatatgtaatatatattatgtatacatacaatatgtaatatatattatgtatacatacaatatgtaatatatattatgtatacatacaatatgtaatatatattatatatacatacaatatgtaatataatatataatatagaaatttatatgtgtaattatatatttatttttatatttatatatttattatatatttatatattatatatatatttatattatatttttgttttgttttgttttttgctccttagatgattttgtctttcttctttaatactgttagtatttcaagaacagttgtatactctgtgcttgaaaattttattatctgaaatgtttaggggagtctaagtctattgttagttaactttgttgactttctttcatgttgacttattaccttgtgtgcttggtgatcttattttttttaagctgtgataatcttataactgtgggtctcattcctccagagatgatttgccttctcctctgtgtgcaagccaagaattgcttccaactggcattatgttagcttccttcaaggatctcagcttcatgtgggaatcagaggttcacattctctaccttggatcactaggcttagtagcccaattttaaccttgctatgggaatttgccacacggagattctaggttttgcttactaagcccccttttggttttagctcagtgttttgttatcctgttattgttttcatctcttggatatatttcttactttcttgcaaatccaacaatattttaacaggaatatgtgttgtaatttaactaggatcagggaatattttactgggtaagtctccagaagaatatccggtccaccatatttctggaactgtggttctggactcctagaatatcctaacttttgtgttgttttcattgttcgccttcattttttaatgaatgtgcctattttttcctataatatttaaggtcgttcagatcaggggttgtgatttatttatttttgtatctcattgacttcttagaaacgactgctactcagtacatgaatatttaatgaaagcagatgtttttgctgataataaaaactaactttcttgcatagtgaaaggctgaactgtgaaagaatacaatggagaatatgagaccagtgacagaggagaaacaagaagagcaggaaactgggaggttgcttagagcagtgatagaatgaggagagactccaaataaaaatttctctcttctccccctcttcctctctgtccatctactttaccatgtatttgagtaatgttttgtgtttcttattctaaattatagagtagattagaatgatttgtttttctttcaaaacaaactaataaccaataatcagataagttactactaaatagatggaccttattatatgttgttgctttctgagtataaatggtccttaggcaggcgaaaatgtgtcttcctcacagcactggacacttctactgagggcatcattgctaaagtgatataactgaaccagttattgcccaagatttatttctcttctcatactctgtattctaagtagtagttgcagaagcagcttttatttgagttattgcagtgcctctggtgcttaagttcttgcctctaacatagatgttattgttaatgtttggggtatttctatctcttgtgacactgttgatattaaagataggggcgcctgtcaattttgtgtttgtgcctgaagaaaagcagaaccatctgctgctagtaacttttccaatttgaaatttgatggaaatattctcagctcggctggcaaaattctctgactcctgtctttgtgtcttgaatcttgttccccacagtcgaaagaaccctcttggtcttatcattgccctagatgagaacaaagaagcaaaaggagaacttttctgggataatggggaaacgaagggtgagcacttatacgataatgttgctgtttcccaacctgcacctgtgacttatggtccttcactcctgctggtcattcagctgtgggagaaatctcagtaggcacagtagcaagagtcacttaagtattttgtttctggttgcaccattcagaggtagtggtagatgacctacaaaggaaagaaaaatacatttctatctctggcaattctcctattggacagtgatatctataataggctttttatttatttatttatttatttatttatttatttatttatttatttatttattgaggtggagttttgctcttgttgcccaggctggagtgcagtggcgcgatctcggctcactgcaacctctgcctcccaggctcaagtgattcttctgtctcagcctcccgcgtaggactacaggtgcctaccaccatgcctggctaattttttgtatgtttagtagagatgaggtttcaccgtgttagccaggatgatctcgatctcctaaattcgtaatctgcccggctcggccccccaaagtgctgggattacaggcatgagccaccatgcttggccaataggctctctttttattgtcaatgggtgcttagaagagatggtttcaagactgttcccgtaacccaatgttaatgtcttcctcctgaaattcttatgagcaaatgttgatgatatagaaatcatgcccctgccagtgaggcagtgagaatatactttttagcatatttgtggatccagtatactaacaattcctgtgcttcaagtttaggaaatagattcccttgaggcatatgccttggaagcccttggaagggaaactttgcaatgttccagtaggaaagagaaggaaaaacaatggcttggccttggagactcttgtccatctaatccaatgtgtagatttaaatatttattttttaattgcaaaatatttaattggcaaataaagatgaaatatattcaaagtggacaatgtgaggatttaatatatatataggcatagtataatgattaccacagctattttaaggaacagatccatcaccacccatactgtagactggatccccagaacctattcatctaataactaaaaatttgtacccttgaccatcatctccccagtttccacacctgcaggctctaagaacaacagttatactgtctgcttctaggagctcaacttttttaggtttcacatgtaagtgagaccatgcagtacttgactttctgtctctggcttatttcacttagtataacgtcctctagattcatccatgctgttgcaaatggcagaattttcttctttttatgtctgaataatattctattgtatatatataccacaatttctttattcattcatccattgatggacacttaggttattttcatatctttgctactgtgcagaagtaaaattaaaaacttaaatgtaagggttgaaattgtaaagctcctagaagaacacaggaaacaacctccttgacattagtcttggcaatgactttttggatatgataccaaaagcaaaggcaaaatagcaaataataaacaagcatgactacatcaaactaaaaggcttctgcacaggaaaataaataatcaacaaagtgaaaaggcaaactacagaatggataaaaatgtttgcaaaccatgtatctcagaagagattaatataaaaaaataaggaactcatgcaactcagtagcaaaagatcaaatgacccaattaaaaagtgggtgaaggacctgaacagatgtttttccaaggaagacatacaagtggctaactggcatgtgaaaagatgctcaacatcagtaagtgacacaggtatgcaaataaaaaattacagtgagctaccacctcacacctgttagcatggaaataataaaaaagataagagataagtgctggcgaggatgtggagaaaatggaatttttgtagactgttggtgagaatgtaaattgttacaaccgttatggaaaatagtatgcatgttcctcaaaaaattaacagaacttccatacaatcccatgaaatcccacttctgggtgtatatccagaggacatgaaaccagtatctttaagagatacagtcactcccacgttcattacagcattatgtgcaacaaccaagatatagaaacaatctaattatacattgatgaatgaatgaataaagaaatgtgatacacatatacaattgaaaattattcatccataaggaaaaggaaaactgctatgtgtgacctcaaggcatagctgaaaggagtggtagggtgaaatctgttcttctgaggtgggcaggccagaatctgacttgtctttctctcactttcagatactgtggccaataaagtgtatcttttatgtgagttttctgtcactcaagtgagtagcatatttttatgaatcttaggtgtgggctttggactgaccattagcacatctgtgcttgtgtatattgtatatgtgtgattatatttgtaactttatatgcattattggctataggtgagtacatttctatttatgatttcatcgatgttttcaaaaggaggcattaatatagcagctagtgtttctgaacacagtttttaaatgcctgtgtgtttttatgatcgttttaaattagaggattatccaaataatgttgtacttcttcagcacacactagtagagaaagcagagaggcatttatggcagtggggggtatccggtctggaatggaatatttgagtgacttgagaatctgtgtatactcatatacctttatgcatacttggacttaattgttttgcagaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggtaaaaacccattttgttgagatggtacattgagaattctccatagcatcgtgatgttccttcttgccaagtttgcatgggtccctgaaggaccagggcacctttgaggcctgttttggggaagtgagagggctggggaaaaaaatgaggtggccagagctagaatgagttgggtatttttcttcttattcccttctctgcctatcagtgttcccgtctttctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagtttggataggaaacttgtggtcaggttttggaggtcttagttaccaacttgatttaattctcaagcagtctcatattgatccttgaatgaaggctgtgctactgtgtgtgagcattgttgggagtgggagtgggggctggggactagtagaacagggaagtacaagatggtttagattgggaggagactaggagaaggatgataatctttagaatgtgatttttgtactccagacaagtgagaactttaacttgggaagtgttgtttaaagaagtgtcaagataagaaaactatatagaaaaatattaaatatttgaactaatggtattcaaggaaggtttcagaattggagtctttgggcttagagaaatgaacatgctgggatgttagaaatagaaagaaatataatgtttttttcaacttttcaaatttgccgttgctaaaattgaaacccaaagaaatgaaacagaatacctgacttaccctgatgtgattattatgccctgtatgcctgaatcaacatatttcatataacccataaatatgcatacctactatatacccattaaaattaaaaattaaaaaaagaaatcatttgtccaacattctacagaaatgtgggcatgataaccaggtcatatgattcttattgctgtgctctttctaccactccacgccaatgggtgatactggtttgggcattggagagcaagaggatcaactcactttaggatgacatcatgtgtcatctcacagcgagctaagaggagtcagggtagaaaagaataaggggtgatcacaacaggttttatttgacctaactgttttcattatgctaagtacaagattgtgctagaggggagacatttgacctgttgctgctaaatagattctcccaatgtgcagttctcttcttataagctaaagtcatatgttgcttggatgtttgaaagtctggtctaatttctattttttttttatcgaaaaaaaaacctcaggtcttgcaaagcctgtctcctaaagatgaatttccttatgatttccacattcctacaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggtaaccatgctgatggggtttgtgtgcatgagaatctccacacctaatctgtagtttcttaagcatagcagtggtacttacataactacttaaaatccatagaaagaacttcctaagggacaggatctagatgtgacaagtaggtggggacatgtgcgaaacttcttaagatgaatattttgcttggagacaaggaattgaaatttatgttattgccaagtgataagtgatgggctagttttatcgtcatataaaatgactttactaaccctgtttaggttagagaactttaagaccacatgctgtgctgatctatgactttggccttacttttcaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaaggtaaacacagtacatgtatcaggtagtgattagacccttttcagttccattaccttttattggtctggatcacagaaccctaaaataagttaatcatgctacaacagactatatcattatccagagagcattgagaaatcattgagggaacaatgagacctgccctaattttcatttggaaaagattactgtggctactgttaggaaaatggttgggagagcaagagtaggtacggagagacaacttgggaggctaccagttaggcaggtcagtggagggattaggtttggactagacagtggaatgcaggtggagaacagtggacccgtctgaggttgagaaagttgggttacaggatctagtgctcaattgcaagcaggtgacaatggagatggaacatcaagaatgatgaccgtgttggtatcttgcatcttaatatggatggtgctgacattaactcaaataggaatactgaaaaagtttgtgcttgatcaatgtaagatgatatgttcagtttgggatgctgaatttgagatttctgtaaaatggccatcaatatgcagtaatttcatttctttccagaatttaattgcatttaaggactagggatggactagctgtgatgtctatttttctattaaactaagcttctcaaggacaggaatgtgccctttcctgtttgtgcttctgaaatctacagagcctggccgatagtgctgtaatgttattgacagagtaagtgaaagtggtcaggacattgtcacattgcctgaaaggttctttacaatctgacatcaacccgaattctgagttcttgttcatcctctaatgcagggaagaatctcttgtatgtttgtaccctccttgtaacactagcatgttttaggcacctaatgggtttgaagtgaatgaacttccctggagttctagccttaaccattgcctactctacctcttgaccgtagagtaactctttccaaaatatgtgcctctttctggcccactttaattctctctgccttcgtggttgttattcttcaccagaatgacttgatctcctttctttgtttggttaatgactaccaagcttttaatattctagactgtatttctcccgtgagaccgtctcagtctcccagaaacaatgttaggcatttccttccctagaatctcacagcacttctacatagctctcccttagcacacatcacccacgtgttgtgagctgctctctttgacttcttattcgcatgtgaatttcgtaaaaccataacactgccttattgagctcacgtccctagtgtcttgtgcagtgtcaggcaggggatgtagtaggtactcatgaatcagtttagataccactttcagcaaggacattctgattattttaatcaaatagatttcattttggggagacaggtttttttttgaactcataatgattttaagttatttatatatactcatatacccacagaaaataacaagtaacatattcataaataccacactgattccagaatgattttccaagtcagcagcaatgtcccattgagtttattaaggtaatagaggccttaataatgagaaatcacagaaaaatgttaaatgtgacattgttatctgatatattaattaaatctcagatatcataaagaagatagaaacatagcatctgaactttgtgtccaaaaatcaaaaaggttctgctaagggtataggtttcaagagtagtattgttgcctaaaattgatttcctctggcctagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataaatactgaaggagttgaatgtgcctgaggattcatccaacaaatgtttatggggtgccttctctagattaggtgctgctccttatacacagctgaggtttctcttctcatgacaacaaataataagtaaatatcactttgagtgctatgtagaaaatggactgaggggtgcaaggatggaaggcagtgctggtgtggagtggtcccagctgtgatgatgaggggtgcttggatttgtattgtggaggaccactgaaaggaggcagtgacagagggaaacggaagaatgatgaataactcctgggcttttagcgaggatatctgtgatattttaatcaaattgagtttcagttttgtttgggatatgaacagcttcttggtaggaatcaagtgttctgttgtccttgaaaagtcacctgctggaaacagagataaaagctcattttctgtttcaaatctgcgtttttgtgtttcagttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccaggggtaaggacagagcatttgggatctgtgtctctgcttctctccacccacactgctcaggctttgggcttcatcttcccaaactccacttggtcatcacattctgcttttaggcaagtgggccaattctcaggctcctttgtttcatgtgtttagtttatgtgtctagtttcatggagaaaactagagccatgttagcaagcacatttttgttgagtttctttctcaggcataatgtcttttaaactcctactgcttcttcccatgactccccagtacaagaagaattcctatggtgtccacccctactacatggggctggaggaggacggcagtgcccatggagtgctcctgctgaacagcaatgccatgggtaaggccatcagcacctcccttattttggggggataccaatcatgcctgagtcaatttacaatgtgtttagcctaactgttccttgaaggcaaaatcttcattttacgggcactgctgtttattttttctttgtgtttagcctttctgtttatttcaatctaatatcatgtaataagaagatttaacccaactctcattttggtaaaaatcacataagaagggatagtaacaccacatgggtcccaaatatcctggagggcagctcgtgagagccagttatataatttgaattagggtaaaactatgggtcagagaagttagtctgggggtattgagggtgtatggtatgttggaaaattacctatcgggtactctgctcactgtccgggtgagggatccataccctaaacctcagcatcatgcaatattcccatgtaaggaacctgaacaggtatctctttatctaacataaaacttgaaatgtaaaaaataataattttataagagtagaatgataaaatatagtaaagtaccctaaagagaatcaaacccaggaatgggacctgtagacttccattgatcttcttcagttctgtgagtatgatagaaaatgcctgctgttactactctatgatagggagggtgcaggaagatggagaatgtgtggatttcaggggtgattcgtgacatggaaggtgtccgtgaggcttggcatttttctttattttcagatgtgacgttccagcccctgcctgccttgacataccgcaccacagggggagttctggacttttatgtgttcttggggccgactccagagcttgtcacccagcagtacactgaggtagggggaaatccaattgtttatcaagtacttacacagcacattctgggtgccagagtccacattgattagtataactctcagttgacaactggaaatattggtctttcttggagagagattatagaatgagaaaaaataaatacattctaattatcattaaatttatagcctctgtaagcattgcagaatagcagaagttatagtggtactagtggtggtgctggtagtgatagtagtgtgatgttggtgttatttgtggttatatggtgatgatggcagtaggggctgacggtggtgatagtgatgtgggaatggtgataatgatggtggtggtagtagtggtgttggtgatggtgatgatagtggtgggggtggtggtaatgggtgtgttggtgatgatgacggtgatagtggtggtgatggtgacaagggtggggctgacgatggtgtttgtggtagtgatggtgatgatgatggtggtgttggttatggtggtggtggtagtggtggtgacagtgaggtggtgtgaggagtgtgatgttggtgatagtggttgtggtgatagtggtgatggtggggatggtggttggggtggtggtgggggtggtagtggggggtggtggtgacggtagtgaagggtaatgataatggtaatggtggtgggggcacgatcgtggtactgggggtgatggtgaaaatagtgatgatggtggtggtgatgatggtgatgatgaccatggtggtcgtggcagcaacaacagacacttacatactaccaagtgcgcatcactgatttatcacttgctgcatgttagagcatttcacacatattaactcattcatgcatcacagaaacactatcaggcagatgctattattatccgttatttacagatgaagaaactgaagcactaagagattacttaatttttgcccaaggtcacacagctagcaggattggagcctgtatactaagccaggcatatgtctctgattctgggtttcttaaccagttatctacagtgtctctaggaatagcgtaacatcagattttccataatttttaagaaggagctcaagtctagcagaaagctttctctaagtatcctagtggctctatatcctgtcagttttggtctggatttcaattagttagttgtctagcttggggcacagaaaaatattcttattacttgatgtaaaacttcaatgtggtgcctctgttctgaagactaatattttctgtctattttctagttgattggccggcctgtgatggtaccttactggtctttggggttccagctgtgtcgctatggctaccagaatgactctgagatcgccagcttgtatgatgagatggtggctgcccagatcccttatgtacgttctcagtcatggctctggagtttcaaaactaacccaggtgcctctgtgtctgggttcatttgtctaatgtttgttggattccataaagacataaagttctttttcagacaatatcacagttagcctcaccccagcacagtaatataggtaagggcacttgtttccgtcttccagagatgacagctcaagacccagcatgactcgccagagtgggagataggctggctccagggctctttctgctctcccgtgcttccttccatttctttcacttggcttcaaaacatgtagtcaaaaaagtccttggtttcataagaataaagtatatcccacagttcttttacttaattcttgaaaagactaaccacaaatcaatcagacaattgtatatgtgaatacaacctcagttcctgcatcagctctgagctaataacagatggattaaacagatcctgggatgggtttccagaggacatacatatggaaagaaaccttatccttcagtggaggatgggaggggacccagtcatcagagaattgatcccatgaaccatcacatatttaattttatcccacttttctattgtttacagttgttccattagtggaatgtagtgtttccattagtggatagtgaaatgcaatattacagtctcaggaagaatgttgtgtatgattaccctcaagattcggtattccaaagcaactatacatctttgctttgttttgtagtagatttactattagtcctggataattaacagtatttttcctaaacatgaaccactgataccaggggcagcctcttggggtaggtcatcaccatcactcctgatagtggcagtttacaaagcactttccaaaccagtgttttctcttatcctcagaatagccatgctagagacgcattctcatcctagcttgtgctgacttcgattttttttctatcttatcactgaacattttaaaaattaagtgtatttcccagcacctgtacctaacaaatggcagagctgggatttgaatgcatcaacaagaagctgtctggaattccaccatgggtggtggagggttgttctcctataaagcttgggcgtgtacagcagcagcctctcagctccccatgtcctcccgcaggatgtgcagtactcagacatcgactacatggagcggcagctggacttcaccctcagccccaagtttgctgggtttccagctctgatcaatcgcatgaaggctgatgggatgcgggtcatcctcattctggttagtcctgatgtgaatgtgtgcggtctgtttgggagcaggtatgggctttggtggagtcagagttatactttatttccatgttgcaagtagataaattgaagtgcagtaagaaaggtgtatttcccaggactcacagaaactctactgtgcaggtagaagccagcgagttcacccttgaggagttctccttcattctgtttctcctcattctctggctttggttttcccaactgacttatgctttgatttcaggatccagccatttctggcaatgagacacagccttatcctgccttcactcggggcgtggaggatgacgtcttcatcaaatacccaaatgatggagacattgtctggggaaaggtataatcctaagcgatgatccactagtccccagcctgagggtgggtcactgttggtgggtcactgttagtgggtcacacgcctgtgtatgttatttttggccttttctatttgggctctgaggtcagaagctctccttttctcaatcaatatttgttgatacaattaacgacttttaaggtaatgtaacgtgttatggagttcacttttcttttatgtcaatcctatgtgatagtcaaagtattattgctcctaggagcacggtttgtataacaatttattaggaaatactatgtaagggaaattgtctagtgcatcgctactgaacgtatttctctccataggtctggcctgattttcctgatgttgttgtgaatgggtctctagactgggacagccaagtggaggtaaaagggtgtttgtaaatttgggtggagtcagggtttgtaggcaggggcagctgttcctgggattgtggacatgcctgtaccgtggacatgggcttggcaagggagaaacacttaggtgatgtgtcttgggtgtcattctgtatgcctattactttataggtagtcatactttactggccactgggatgtagatatgtattattatccttggaatttaagaccagagagcttaaattatttgttcacagttttaggtgacagagtggtgatttcaattccaaggctgtcagattccaaaggcccaagaaattcccactgggcgatacctcctagcagtgccatcttttctctgaactggcatacttactgttgttgcctcggttatcccttttaaacagtcttcaaccctcgaagactgactaggtcattttctttgtatatctttctttttttccccatgaacaggtgtctccatcttcatacttacgagtcctgccccgagccccaccattccttgggtttctcaactttgcttttacctgtcagtttccagccttattgtaaaacttgctctctcctggggacggtttgttgcttgtaatggatccaagtagtccatgcttctggacctgaatttttttcccgattgactaagcatttcttgcttgaatgaatacatggctccttacaggagagtggagaaagtgaaggcagaagccacaaggcaagagttgaatatggacaggcaaagccagcaccttggagaacggcagaacatttttatgaagttggaaagggtcatccgagcagtacttagggaagttcctacctcacggctggccaggttccctacgtgtaccccgtatgggatagaattctgactcagctgtggctgataatctctttattctaattctccatcccccacccatcccgtcgtttctaaccctgcctgatctggagctctcagtttctggtgaaaggttctctttgtcgggtttcctggttcctacctccatttcctaacaaaaggcatccctggcatgcccacgtctctcaagattctctgtgatgtgacccactgtcttctcacatccttgactgccagacccatataggctgatctgtttctgttttcttatgttcccttttctgccctttttctagacatctgggttcctacctgccctttatctgtggtgtataagaactggagctcccctagaccaagtcctgtttttgttgccttccccaccctcctcaccagcattctttagctctttcactcttacaatggtgtgattatcatagaggaggctatttactgagacaaacaaaggactgtaatgttctataacaaacaacatgagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaactccctgtatatgtttcagatattaggtcacgaaaacagattttcagcatcaggattttcctttcaaaaggaaaagaaagaacccagttagtctggttgtcattattttaagagccttaaagcagaatcctcttgattcattcactaattcatttgttcatgatatgaagtcatagagccagacagagacagaattagaactaagacacaagtctcttgaattctagtatgcagtctttatcccccaaagcacttccctttgctgctttatgtttgtatgtaaagtcttggtttgtggctgtggctttacttttagctaatgcctctctgcctgctcactgcagccgccagaaattcatgggcttcaaaattgccttggatgatgaaggaactgctgggggctggctcttctgggatgatgggcaaagcattggtgagtagaggttgcctgagattcatgctgatggcactgactacattcctggattatcttacaggcctgctttcaccttttccctattataacaattttgcattttaaaatataatcatttgttaattcaagggtataatccatattggacatgatctttattcctcatgtaaatgaagctcagttctgaatcacctcccattatgcaacctttgtaatccactatagaaggtagcaatatgggagccatggggaaagtttatttgtagccagcggagataaactttcataggatttatggtcaaggacacattcccgaattacatggtttactgtcccagtaagaggggtaatacctctatccgttgtattatttatgggatattttctattaggagtttataggaattggtaaactctcaggaggattgctcaagaaattattagctatttctagacaagtgctatccaatagaactttctgcagtgatgacaatgttctatatcttctgctgttcaatattgtatctagtaggcatatgaggctatcgagcatttgaaatgtgtgacaagtgcatctgaagaattatatttttaattttattcaatcttaacaagcttaaatttaaacgtgttacattttactagtgactgctatcttagacagcacagttctaagggatagccagtggcaactgactgagtggtgagtcatttagaaaagggccagcacagtcgagctcagtgcctcacgcctgtaatcccagcactttgagaggccgaggcagccggatcacctgaggttgggagttcgagatcagcctgaccaacatgcagaaaccccctctctactaaaaatacaaaaaaattagctgggcatggtggcacatgcctgtaatcccagctacttgggaggctgaggtaggagaattgcttgtacccgggaggcggaggttgcagtgagccgagatcatgccattgcactccagcctgggcaacaagagcgaaactctgtctcaaaaaaaaaaaagaaagaaagaaagaaaagaaaagtgaaagaaaaagaaaggggccagcacacaggaaagagtgtgacagccacgagggcagggtgtaggatgggaatacttgaaaccaagctattgactagttcaccttcaccggctgtgctgaacttcatattcttcctaggcctgtggcacacatttaggataaaggacaaagaaggcttttctttgatcatctttgttctctggagatcacatttttaaatttgcctaatacctcaagataaacccaccaagacaccagtgttggtgtttgcatatgtatatgcatataaatgtgtgtgtggagatgtgtacatacagcaaaagaaacctggaaattctgagctggttaggaagatgctgggatggtagaccacaaggaagagaagtgacttaaaaatggtgtcaggaaactgtgttatatgaagtgactctgtcagacagatgtgtctatacacattcatttcaagcattttgtgtaaactgagtgtgggtgcagggtttgattagtctccataaagagcacttacattttaaaatagaacactcaaaagacagaaataaaaacaaagataagccttactctctcaaacaagacaagtaggcaattagaacagcatttatatattctatagcatagagttctacagcacaggtccaggccatgtttatcttgttttttgtttgcagatacctatgggaaaggactctattacttggccagcttttctgccagccaggtgagtgtgattgatatgaagtgagaatagggttccactggcttaggagggtgctgaatatcgtaagggcataaaataccacctagaatttcttcattgctcatcttgctaattcacattcttctacttctctagacttccggtggaaatttactatgctcccaggaggctttctgcaattaaacctatccacatctcatcagtaatgatcattattctagtttaccatgttacaggtggacgggcagtttctgttatctagcccttgttcctgagttgccttggaatggtctgcacattttgggattcctccacctgtagaatataagtatcttaacagctgagactttttgtctcctgtagagttcagggcagtgcgaaagaccctgtagctgcttgtcaatgcaaagtggatgggagttggcaataggccatagagtgatgaaatcatgatttccatgatccaaagttacaagatggtgactctgaagttgtcttactttatgacctacatttgtgcctaaaaagaggttagaaaaatttgaactaattctgctattatatttttcttttatctccaattcaacagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtttgtgaccagcaaaaagtgcgaatggtattctccacccttaatatgcctagtgcagtgcctgactgcttcccttccaaatgatgccctctcctgccaggccctccgggaatccctgagttttccatgtgttaggaatggaccacgtggagatgaatgaaaaatcatggtttatcatcatttggaatccatggcctggattcttactttccatgtttgtcttcttgtctgcaaacctatgtaaaactttgtcttgactccctcacctctgcctcagagatcaacttcccaaacaggttggaactatcatattttatcaaatatgataccatcagtgaaaattgcttcattatttcatgtgccacaaagaaagaaaaaaggatgacaaaactatgatagaatgcttccttatcactcaattttttttttttttttgagacggagtctcactctgttgcccaggctggagtgcagtggcatgtgatctcagctcactgcaagctctgcctcccaggttcatgccattcttctgcctcccaagtagctgtgactgcaggcgtctgccactatgcccggctaattttttgtatttttagtagagacaggttttcactgtgttagccaggatggtctcgatctcctgaccctgtgatccgcctgccttggcctcccaaagtgctgagattacaggcgtgagccactgtgcccagcctcagatttttataataaacttatagaaagtttttgaaacttctttagccataaagttttacctatatatttcaatattgtaagtgataatatggaggaaaatgttgagtggagatacattgatgattctgcctcaacgtaatttaaaagaggtagaccctaaatgtgaagaagcactagaaatagcttaaccaacttgtatcgtatttaaattgtactatttaaattcatattaaactgttttattatttagtttattgtatttattattatttagaagaaaaatatgtgttacaaattggttaagatatttcctctgtactgcaaaaggtgttggtgattcagcattttataaaaattcttccactagtgtctatgaagtttttttcctgagccactaacacactttatatacattttcatcctagtgctttcttgatcttactaaatattccttcctgtaataatccttaaatgttttcagcccatccattcataacacagtaatagcaatgaagcttacacaggcacagacaataacaattatgccatgagtgctgcttggctcacagtaattctatggttgtcgattacaagacacgctcttgtcagatgaatgttaaatatgtgaaaaatctgtaccttgggattaatgctgtgtagtggtcctgacacttatcatcccgatggtaaatgaaactttcttccttgtgtgcttacttattattttttttcctgaacttttttctttcataatccttcctgatgattaagcctgaaacaaaagttttctttcagttttgcattctttacagttatttcctcatacttgtggttttcttgtcaacaacttccccaactataccataaaggactttgcccaatcctgttgctgaccagctcagggacagacatgcaagctgatgagggcacatgcagtgaaagcttcttgacagcatctgcctaggaagaagcaggaatagtggactcttgctgggcaaacactggggtgctatagtggaataggagaaggaggaaacagaaggatggtgccaaggaaaatcaacacctcagtagaatggaaaagagggcattctctccagtttgtgcagttgtttctcttcagcggttgcatattgaacattttttttttttttgactgagtctcactctgttgcctaggctgaagtacactggtgcaatcttagctcactgcagtctccgcctcccaagttcaagtgattctcctggcttagcctccctagtagctgggattacaggcacctgccaccacgcctggctaatttttgtatttttattagagctggggtttcaccatgttggccaggctggtctcaaactcctgacctcaaatgatccacccacctgggcctcccggagtgttgggattaccggcgtgagccaccgcacccggcccatattgaattatttaaaggcccatctctaccactgaataatctttgtactctaaaaaattagaaaacacccttctcatctgaaactttgaaggcagtcttttaactagacaatacaatgtagaagtattagggggttatttggactggatacttgcacctgatttatttgcatgcaggaaatttcaacaccggatgcccaattcttttcctttggttcctaacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 501 - DNA, 171024 bp, Homo sapiens
catggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 502 - DNA, 184281 bp, Homo sapiens
aatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 503 - DNA, 190570 bp, Homo sapiens
gatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 504 - DNA, 164574 bp, Homo sapiens
tctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 505 - DNA, 177962 bp, Homo sapiens
aatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 506 - DNA, 211148 bp, Homo sapiens
aatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 507 - DNA, 184281 bp, Homo sapiens; identical to SEQ ID NO: 502

SEQ ID NO: 508 - DNA, 217487 bp, Homo sapiens
gagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgattttgaatatgaattagagatcaatttattgcatttactgaacaatttatttaaacaatctacataactgttttcttatttttacattttggcacttccatcattaagtcataagtaatagaccatgaaacactgaaaaacacctcagcaaaatttgtaaattaaacatttcccataaatattttctctcttaaaaattgaaaatcacaatcggaagaaattaaagaatttgattatataatacgtattttcaactgacactgtctatccaatctgtcggatagtgtttggaataacctatatcctggacatttcttagattgttctttggatcaacaatgcccttgtctatgcaatagttaataagctacattttttttttgtttgtttgtttttgttgagacagtcttgctctgtcacctaggctggagtgcagtggtgtgatctcagctcactataacctctgccacccgggttcaagtgattgtcttgcctcagcctccttagtaactgggattacaggcgcccaccaccacgcccggctattttcttttttaaattttttatttttagtagagacggggttggtctcaactaaatgttggccaggctggtctcaaactcctggcctcaagtgatccaccctcctaggcctcccaaagtgctgggattacaggagtgagccactgcacctggtctttttatttgtatttgaaagcagcctgagtggatattttaacaccagaatttccaaaagtatgtagcacaggttgttacaacaaaatgacagcacttaggaataactgctaatcttaagtatgttttttataagtaaaataacccattatttggtataaagatttcacactgataacatttttgagttatcaggcaaaaatagagagtattgagaaaagagaccctctcaattttgtttaatttgaaaatattaacatttaaaaatcacactggggtttttcaggtggtgggactttttcttcatttaagtggagactacccagtctttatgttaatggttgataaatcatcctttcagtatcattatcattaggccaatgtgtgcaggcctcccactgcagagattgactacttttttctggcatctaattctatgcgtgggaatacattttccattaatgtgagctcactcaattttacctggaagcatccatattcctaatgaaattggaatttttccaaaagatgaggcctggtcttggatgactacattttcacttgaaacatttattttgggtaattataacactgaactcgacaagtaaatgttacacttggaaagaacttttttagcttttccaaccaaaggcagatgtattgcaataaaataactgtcttaaacggtcctctactatttagttcttagttatttgctgtttattctaaatatatgtgcatattgataaatcatagaaataacttccactagtgatcttacctttagccatttcatagttaggtcagaatatccatttccaagtaatacttgaccactatgtttctaccataggtaaatgataagcttctaaaattatattcacatatatccaaatctccaggagtcacaatctgttgctctataagttttttcaaaacattcttatttacattttttcttggttgtctaagtgacatctaggtggtagtagaaattattcactgatactttatctacaaaatggctcaatcttctaaactcatagttcctttaatattacctttatctcttaataatcagtatggagtctactctgctataaattctcatgtgacattccattttgcaattagtataactcttaaaggtactgaaaagtgcagtattacaataagttgtcaaaggcatctcattactatgaagtccatgaagtttaaaaattttaaatttatctcttattttcaaactagctaccatctttaaaaattcagcaaagtggtaactggaatattaatagctataattatttcttaggtccatgcttttcagaaataatgcttaaatgtttacttacttcttcataatatagcacaatataatcatttagaaattatgtaagtttgatattaacaaatatcattaacttacatttttatttatcttgcttgaaaaagttaattcaaaatattaatttatttattcatgaaaacaacaattgataatttatcctattctaaatatgaatgataaaatctgagtaagttgcagtcctggcttccatttcatgaatacacaggaaacaaaagctgaaatgaaaacttttcccctaaatatttaaatcacatgtttgatttcatttttaaatggtctgggtataagcaaaaatttgtacattattttatttctctaaatttgacctctttccataaattttctttgccccacttccaaatgcggcgagaattcatgcttctcattgaattcacagatatctttagaatgttttattgcttagtgttaaatatgttgagtaaatactggcttatgttcctaggttacttttctcccttcactgtttagttaaataatcaattctttcaagtaacaacttttaaaaaaactggaatctagaaattcatcaggagtggagatcatcaaaaacgtaattactttatattgttaacattttagtatatacaggtaaattcaaatacataaagagtgtggaaaaattaaacctaatatattcttaattgatgtgatgtgagtgtaacaaatatacaaatcacattcccacaataggaaacaaatttcctgtttgaatttctctgtaaaggaccgacttctgaaatctttatgtaagttacagtcaagacagttgatgaggctatagttcttgaaaaaggggcatgggagggaattacagacattctacaaatttaaaaaaccataaatgtacatattttaagaaattaacagttgctgtaataacataaaagtagatatatgtatgttttaatatatacagcacacacacacttttaaatacttcaacatctcaatgttttgatgatcataaatctgaaaggatctgatttttctataaaatgtaacttgggtggtaaagaggttaatggtaagttgtcttgaatcagattgaaatcccatcgtaccaagagataatatcgttttacttaacctctatgtgtttataaaaagcgaataatattaaaacttatttcagaggattgtgataatttaacgggataattccattaagacaaatagaaaagtggctgtcacatgggaaatatttccaatagatgtccactgttaaaacaggaatcacaatattttagtgtatgtcatgaattagcacaattgatagtgaattagtataaaagttctaaggaaatatttagataaaatataaggactttgaggagtgaccgaaggatattacaattgaaactagaaattttgggaaagttcaaacgacatacaaggaaaagaagatacgtttacatatttaatacttacacgtttagccacatgatgtcgctgtccaccacaaggtctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 509 - DNA, 156297 bp, Homo sapiens
gatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 510 - DNA, 226055 bp, Homo sapiens
aatggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaagcaaagaaaaatgtagggacaaattgtcgtatttcttgatttaaatggcaggttaaaaaagctacaatacaaggtacaataaaaggtaatgttggtcatatttaacacaatatctcaatgtagtaaaataacagtgacatattcggggtaacttattatgttatcttttctggtgaaatgtcaagccccggacaaacaattcttgacaaagttacagaaatcatctgccttccctttacgtggctaagtttcaaagtgaacaataaactgaagttttaagcaaacgtaatttaaaatacatttattggctgggggcggtggcttatgcctgtaatcccaaaactttgggaggccgaggagggcgtatcacctgagatcaggagtttgagactagcctggacaacatggtgaaaccccgtctcaactaaaaatacaaaaacattggccaggcctggtggtgggcgcctgtaatcccagctaatggggaggctgaggcaggagaatcgcttgaacccgggaggcagaggttgtagtgaaccgaagtcgcaccattgcactctaacctgggcgacagagtgagactctgtcaaaacaaaaacaaaaacaaaccaaaaccgaccaaccaaacaaacaaaaaacaccatttattgggcgatttgtttaatttctttatgaaaacatacaaccacgacttcattgtcattgtgaacaatttcctgatgccattaaccttgaattcccctgggtctagaaggcttagcattgcatgtatttgctatttcggggatccagttaggaaacacttattaagcacctcccattcctcccattcactcacaaatgttctaaaaccctttacttttttagctcattcgatccttccaacgattttatgaagtgaagactttcgtcacattttgtggataaaggtgctgaggctcgcaaaacctaagttcagtattattactaagttttcttcaaatttcccgaggatatccaaaaacttgcttgctgttaatacagttctttacctttcctaaaatgtttaaggtggcttacagtggaagaaatttgtgaaagcaaattattaaaaaatctgcttaaggtcaaagtaaaagatcaagagaaaggtgggagtcattatttcaaaaatcaagcctaggctgagtgaaaatcccaatacttaccttcctgtaagtcaatatagaagtatgaaaaaataacaataaaaggaaattctctataccatttcttcaagagagaaaaaatagcctcttcctgctacaaaatcaaggaagatttgattactgatgattgtgtaaaggttgagaaatatactgggcagcacgttttatagcagttttgcaaaacccacggaaatatccttgatgtagacatcattgtatttggtagtcattcagtcaagggcataatgttaaattttatttcctatgtttgcttctgaagttacttaaatattaaatgaatatatttttgtttgtcaaactttcaaacatacatgaatgtccccttgtgaagacattctatgagaaattaatataatttgctagttaagtttccagagatttgagttgatacagagttgttgcttagagtattgtaaaaaataggctgtaaacatgttctgtaacttttaatatattatcgtactcagccttttggcaagaatcagaaaaaaataatcttagcatcacgttgccaagaaaatgtcccagttcctcaaaatatgagacaaactttgcaggattataaaattggaaaaaatagatcagaaaatcacaaaataatttctctttccaattcacattactgtgtccccaaagcttcatttgctaacagtattaatggccaggcttaggattgcctttacatacattcaatatttctttatttagttttctaggttagttgagtgtattaacctgaaggtgaatcacaaataatagtgaattactattaaaccaaaaataaatgggcgtaggagtacaaaatttgaaaagtaatttttatgaaaaggtaattctagaatggaggaaaaaatgattgtggagtggtattgtcacttagtgtttattttaatgtaaatatgaatggatttcccattggtagttaaagttcttgctccattccaaatcttcatatagttaacacaactttcaacaggtttatctttcttcacaagatttcatccacaaactagtaaggtatcatttgagggaccttagagacttgtggtcagtgaaggatgcaaatagatgaaaatgagaaatagtttatattgctagccactaccgatattcctctgagaatgctggaggatttcacttttctgttattttgaggtagcacgattgtgtaatttcctttggccaatgaaatgtgaatggtgtgtcacttccaagcagaattatgtaactgccagtgaaagactcttctgctatcttttcctgttacagcaattacataagcactggttgatactgagacaccataaagtcaaagcaatccaggatgctgagccaacatgtggagaaaagctgtcataggaagtccccaataactacaaaggactctgcagcagcaagaaataaaattatgtttattttagaggaaaaactgaatgttaactcacaacagcatatgtattgaggtcccactgccattaagctaatatgaaccagataaattttaagaggggggcattttttttacaacaggaaatacaactgtaggagaacattattgttgacactttttactaagacatctgaccgttaagcagattagataacttgaattccatggaaaaaatctactgtgttttgatttctttttcttaaatataaaaggtagcagaagaaaaataataaactgaaatttaaaatgtcatagatattccttcttttttcttgcttagcatccactccccttgttgtttttttcttctggggtcttctagtagttttgtgaaagactaggttgaaggttttgcaagaatgagtgcttggacatgtaaacgttaagggatatacagttccatagataggtgcaaagggtataattttagcaatgggtactatattaatttccttgggctgatgcaacaaattaccacagacttggtggcttgaaataacagaaatttattttcttacagagtctctgtaagaataaatttcttctctcttatggaggccagaagtccaaaatcagcgtgtttcctgggccgcatttcttctgaagactttaggggaaatttttttcttggatcttccagcttctggtagctcttggcattgcttggcttgtggcagcataactccagttcctgcctctgtcttcacatttccttctttcctgtgttactatatgccttctctttttctgtcttttataaggggcaaccatcattggatttatggccttctgtaatctaggatgatctcatatcaagatcctcatctttgttacatctgcaaagacctttattccaaataaggtcacttatttaaacctcagaaaagtgatgtcttttggggtatctttgacccaaaacaggtaccaagagatatcaagtgcagtgggaggaaggatatttgctgagcatggcttcttaatctcttttccccgttgtgggggaaatgtacttgcatatctggcaatagtattctatctccgggggaagggggaaatattccatattctcagaaatcctaaataacagcacaaaatgcctcttatacccccacatatgtcattctgaatatccggtataattaattaccttatatgattgcagaaattgtctcaagcaagccatgtttcctgaagctagcatctggattctaggtataattccttctatgtgtcaacagtggtcaatgttggctatagattaaataataattactgggtatcatacatatgcaattgctttgcaactacataatgctgtaacgagcagttctgaagctatctgccatctgtttaagctccaggagaatttgggtacatgccatgacctccacttttcagttcacataaaaaccaacctcccacttttcagttcacataatttaggtggagctgatttcatttcctggcttcaagaatgagcaagtggacccatgtctagccaatgtgagaaaaatcacaattattgactaaaggaaatttacatcatccaaactgggctgtaggaagtaatatccaggatttttgctggactattagaaaagagcactttctggtaagagtcatcaaactggtaatttttagtctagaaagctactttggccattttgccagcagatgggaaaagtctatctgagaagaagttcagcaggggaaaaggaattataaatgtggagattattttccttatggaattatggaagggtgtagacccagctctgtctgaaaccagtaattaattacccatttccatgtatgagtcagtacaggattctctggtttatttttgcttaaatcggttaacttgggatttactgttagagtatgattaacataaatacacatttccatagatggtacaaatgagtatcttaagatactgtacatgagggaaaaaaattgttattggaaaaaaagctagcttttcttaacaagagctttgcttttctcttacggacattgcaaattttgcaattaattttacttctctctttgctctaggaagctgaaaacaaaattggtgacatggttagagtaactgaaggtgaccctttattatggattttgtatgctatcccactccttgattcattttatttcatcctcatcttatctttattctattttcatttttttactgtgaagggatcagctaaaaattaacaaaagaagatattctcaagtaattaacacaaaaaaagagatcgattgtattgttcttgcataaaagtctaaatgtaatggaaaaggaatattctaaagtaatagtacattatccaaatgagaaacaaataaattattaatttcaaaacatttgcaaacaattcaaaaatcaaaattaaatcacaaaacaacagtatatatacacatatattttcaatggactaaaatacctttgattactatgttcttcatttgaagaaatagtgaaaaatgctaatatatccaaaagaattgaaagcagggtctcaaagaaatatatgcacacccatgttcatggcagcactgttcacaacagtcaagaaatggaagcaactcaaatgtccacgaatacttgaatgaataaacaaaacgtggtgtatacatatgttggactattattcagccttaaaaaggaaagaagtcctgtcacatgttacaatatggatgaaccttgaggaaccatccacggatgcttgaatgaataaacaaaacgtggtgtatacatacgatggactagtattcagccttaaaaaggaaataaatcttgtcacatgctacaacatggatgaaccttgaggacattgtgctaagtgaaataggccagtcacaaaaagacaaatactttacgagtccacttacacgaaatatctaaagtagtgaaattcatagaaatagaaaataggactgtggttaccagagactggagtgacggtgaaaagcggagttgttgtctaatgggtatagagtttctgttttccaagatgaaaaatttgtaacaatgtgaatatacttaacattactgaaatgtacatttaatcatagttaatatggtaattttaaatattatgttgtgtgttttttaaccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagagtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgattttgaatatgaattagagatcaatttattgcatttactgaacaatttatttaaacaatctacataactgttttcttatttttacattttggcacttccatcattaagtcataagtaatagaccatgaaacactgaaaaacacctcagcaaaatttgtaaattaaacatttcccataaatattttctctcttaaaaattgaaaatcacaatcggaagaaattaaagaatttgattatataatacgtattttcaactgacactgtctatccaatctgtcggatagtgtttggaataacctatatcctggacatttcttagattgttctttggatcaacaatgcccttgtctatgcaatagttaataagctacattttttttttgtttgtttgtttttgttgagacagtcttgctctgtcacctaggctggagtgcagtggtgtgatctcagctcactataacctctgccacccgggttcaagtgattgtcttgcctcagcctccttagtaactgggattacaggcgcccaccaccacgcccggctattttcttttttaaattttttatttttagtagagacggggttggtctcaactaaatgttggccaggctggtctcaaactcctggcctcaagtgatccaccctcctaggcctcccaaagtgctgggattacaggagtgagccactgcacctggtctttttatttgtatttgaaagcagcctgagtggatattttaacaccagaatttccaaaagtatgtagcacaggttgttacaacaaaatgacagcacttaggaataactgctaatcttaagtatgttttttataagtaaaataacccattatttggtataaagatttcacactgataacatttttgagttatcaggcaaaaatagagagtattgagaaaagagaccctctcaattttgtttaatttgaaaatattaacatttaaaaatcacactggggtttttcaggtggtgggactttttcttcatttaagtggagactacccagtctttatgttaatggttgataaatcatcctttcagtatcattatcattaggccaatgtgtgcaggcctcccactgcagagattgactacttttttctggcatctaattctatgcgtgggaatacattttccattaatgtgagctcactcaattttacctggaagcatccatattcctaatgaaattggaatttttccaaaagatgaggcctggtcttggatgactacattttcacttgaaacatttattttgggtaattataacactgaactcgacaagtaaatgttacacttggaaagaacttttttagcttttccaaccaaaggcagatgtattgcaataaaataactgtcttaaacggtcctctactatttagttcttagttatttgctgtttattctaaatatatgtgcatattgataaatcatagaaataacttccactagtgatcttacctttagccatttcatagttaggtcagaatatccatttccaagtaatacttgaccactatgtttctaccataggtaaatgataagcttctaaaattatattcacatatatccaaatctccaggagtcacaatctgttgctctataagttttttcaaaacattcttatttacattttttcttggttgtctaagtgacatctaggtggtagtagaaattattcactgatactttatctacaaaatggctcaatcttctaaactcatagttcctttaatattacctttatctcttaataatcagtatggagtctactctgctataaattctcatgtgacattccattttgcaattagtataactcttaaaggtactgaaaagtgcagtattacaataagttgtcaaaggcatctcattactatgaagtccatgaagtttaaaaattttaaatttatctcttattttcaaactagctaccatctttaaaaattcagcaaagtggtaactggaatattaatagctataattatttcttaggtccatgcttttcagaaataatgcttaaatgtttacttacttcttcataatatagcacaatataatcatttagaaattatgtaagtttgatattaacaaatatcattaacttacatttttatttatcttgcttgaaaaagttaattcaaaatattaatttatttattcatgaaaacaacaattgataatttatcctattctaaatatgaatgataaaatctgagtaagttgcagtcctggcttccatttcatgaatacacaggaaacaaaagctgaaatgaaaacttttcccctaaatatttaaatcacatgtttgatttcatttttaaatggtctgggtataagcaaaaatttgtacattattttatttctctaaatttgacctctttccataaattttctttgccccacttccaaatgcggcgagaattcatgcttctcattgaattcacagatatctttagaatgttttattgcttagtgttaaatatgttgagtaaatactggcttatgttcctaggttacttttctcccttcactgtttagttaaataatcaattctttcaagtaacaacttttaaaaaaactggaatctagaaattcatcaggagtggagatcatcaaaaacgtaattactttatattgttaacattttagtatatacaggtaaattcaaatacataaagagtgtggaaaaattaaacctaatatattcttaattgatgtgatgtgagtgtaacaaatatacaaatcacattcccacaataggaaacaaatttcctgtttgaatttctctgtaaaggaccgacttctgaaatctttatgtaagttacagtcaagacagttgatgaggctatagttcttgaaaaaggggcatgggagggaattacagacattctacaaatttaaaaaaccataaatgtacatattttaagaaattaacagttgctgtaataacataaaagtagatatatgtatgttttaatatatacagcacacacacacttttaaatacttcaacatctcaatgttttgatgatcataaatctgaaaggatctgatttttctataaaatgtaacttgggtggtaaagaggttaatggtaagttgtcttgaatcagattgaaatcccatcgtaccaagagataatatcgttttacttaacctctatgtgtttataaaaagcgaataatattaaaacttatttcagaggattgtgataatttaacgggataattccattaagacaaatagaaaagtggctgtcacatgggaaatatttccaatagatgtccactgttaaaacaggaatcacaatattttagtgtatgtcatgaattagcacaattgatagtgaattagtataaaagttctaaggaaatatttagataaaatataaggactttgaggagtgaccgaaggatattacaattgaaactagaaattttgggaaagttcaaacgacatacaaggaaaagaagatacgtttacatatttaatacttacacgtttagccacatgatgtcgctgtccaccacaaggtctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 511 - DNA, 226055 bp, Homo sapiens; identical to SEQ ID NO: 510
